(12) United States Patent
Esau et al.

(10) Patent No.: US 7,683,036 B2
(45) Date of Patent: Mar. 23, 2010

(54) OLIGOMERIC COMPOUNDS AND COMPOSITIONS FOR USE IN MODULATION OF SMALL NON-CODING RNAS

(75) Inventors: Christine Esau, La Jolla, CA (US); Bridget Lollo, Encinitas, CA (US); C. Frank Bennett, Carlsbad, CA (US); Susan M. Freier, San Diego, CA (US); Richard H. Griffey, Vista, CA (US); Brenda F. Baker, Carlsbad, CA (US); Timothy A. Vickers, Oceanside, CA (US); Eric G. Marcusson, San Diego, CA (US); Erich Koller, Carlsbad, CA (US); Eric E. Swayze, Carlsbad, CA (US); Ravi Jain, Carlsbad, CA (US); Balkrishen Bhat, Carlsbad, CA (US); Eigen Peralta, Chula Vista, CA (US)

(73) Assignee: Regulus Therapeutics Inc., Carlsbad, CA (US)

( * ) Notice: Subject to any disclaimer, the term of this patent is extended or adjusted under 35 U.S.C. 154(b) by 0 days.

(21) Appl. No.: 10/909,125

(22) Filed: Jul. 30, 2004

(65) Prior Publication Data
US 2005/0261218 A1 Nov. 24, 2005

Related U.S. Application Data

(60) Provisional application No. 60/492,056, filed on Jul. 31, 2003, provisional application No. 60/516,303, filed on Oct. 31, 2003, provisional application No. 60/531,596, filed on Dec. 19, 2003, provisional application No. 60/562,417, filed on Apr. 14, 2004.

(51) Int. Cl.
*A61K 31/70* (2006.01)
*C07H 21/04* (2006.01)
(52) U.S. Cl. .................. 514/44; 536/24.5; 536/23.1
(58) Field of Classification Search .................. None
See application file for complete search history.

(56) References Cited

U.S. PATENT DOCUMENTS

| 5,801,154 | A * | 9/1998 | Baracchini et al. ............ 514/44 |
| 6,258,601 | B1 | 7/2001 | Monia et al. |
| 2003/0228691 | A1 | 12/2003 | Lewis et al. |
| 2004/0053411 | A1 | 3/2004 | Cullen et al. |
| 2004/0053876 | A1 | 3/2004 | Turner et al. |
| 2004/0058886 | A1 | 3/2004 | Scaringe |
| 2004/0086884 | A1 | 5/2004 | Beach et al. |
| 2004/0086911 | A1 | 5/2004 | Cabello et al. |
| 2006/0247193 | A1 | 11/2006 | Taira et al. |
| 2006/0252722 | A1 | 11/2006 | Lollo et al. |
| 2007/0049547 | A1 | 3/2007 | Esau et al. |

FOREIGN PATENT DOCUMENTS

| WO | WO 8809810 A1 * | 6/1988 |
| WO | WO 03/020931 | 3/2003 |
| WO | WO 03/029459 | 4/2003 |
| WO | WO 03/093441 | 11/2003 |
| WO | WO 2004/044123 | 5/2004 |
| WO | WO 2004/057017 | 7/2004 |
| WO | 2005/054494 | 6/2005 |

OTHER PUBLICATIONS

Kawasaki, H. et al., "Functional analysis of microRNAs during the retinoic acid-induced neuronal differentiation of human NT2 cells," *Nucleic Acids Res Suppl*. (2003) (3):243-4.
Brennecke, J. et al., "Towards a complete description of the microRNA complement of animal genomes," *Genome Biol*, (2003) 4(9):228.
Carrington, J. C. et al, "Role of MicroRNAs in Plant and Animal Development." *Science* (2003) 301(5631):336-338.
Smalheiser, N. R., "EST analyses predict the existence of a population of chimeric microRNA precursor-mRNA transcripts expressed in normal human and mouse tissues," *Genome Biol*. (2003) 4(7):403.
Baehrecke, E. H., "miRNAs: Micro Managers of Programmed Cell Death," *Curr. Biol*. (2003) 13:R473-R475.
Ambros, V., "MicroRNA Pathways in Flies and Worms: Growth, Death, Fat, Stress, and Timing," *Cell* (2003) 113:673-6. Erratum in: *Cell* (2003) 114:269.
Kawasaki, H. et al., "Hes1 is a target of microRNA-23 during retinoic-acid-induced neuronal differentiation of NT2 cells," *Nature* (2003) 423(6942):838-842.
Seitz, H. et al., "Imprinted microRNA genes transcribed antisense to a reciprocally imprinted retrotransposon-like gene," *Nat Genet*. (2003) 34(3):261-262.
Xu, P. et al, "The *Drosophila* MicroRNA Mir-14 Suppresses Cell Death and Is Required for Normal Fat Metabolism," *Curr Biol*. (2003) 13(9):790-795.
Lim, L. P. et al., "Vertebrate MicroRNA Genes," *Science* (2003) 299(5612):1540.
Doench, J. et al., "siRNAs can function as miRNAs," *Genes Dev*. (2003) 17(4):438-442.
Zeng, Y. et al., "Sequence requirements for micro RNA processing and function in human cells," *RNA* (2003) 9(1):112-123.
Dostie, J. et al., "Numerous microRNPs in neuronal cells containing novel microRNAs," *RNA* (2003) 9(2):180-186.
Lagos-Quintana, M. et al., "New microRNAs from mouse and human," *RNA* (2003) 9(2):175-179.
Calin, G. A. et al., "Frequent deletions and down-regulation of micro-RNA genes *miR15* and *miR16* at 13q14 in chronic lymphocytic leukemia," *PNAS* (2002) 99(24):15524-15529.
Moss, E. G. et al., "MicroRNAs: Something New Under the Sun," *Curr. Biol*. (2002) 12(20):R688-R690.
Caudy, A. A. et al., "Fragile X-related protein and VIG associate with the RNA interference machinery," *Genes Dev*. (2002) 16(19):2491-2496.
Lee, Y. et al., "MicroRNA maturation: stepwise processing and subcellular localization." *EMBO J*. (2002) 21(17):4663-4670.

(Continued)

*Primary Examiner*—Tracy Vivlemore
(74) *Attorney, Agent, or Firm*—Pepper Hamilton LLP

(57) ABSTRACT

Compounds, compositions and methods are provided for modulating the expression and function of small non-coding RNAs. The compositions comprise oligomeric compounds, targeted to small non-coding RNAs. Methods of using these compounds for modulation of small non-coding RNAs as well as downstream targets of these RNAs and for diagnosis and treatment of disease associated with small non-coding RNAs are also provided.

40 Claims, 1 Drawing Sheet

OTHER PUBLICATIONS

Hutvagner, G. et al., "A microRNA in a Multiple-Turnover RNAi Enzyme Complex," *Science* (2002) 297(5589):2056-2060.

Pasquinelli, A. E. et al., "Control of Developmental Timing by MicroRNAs and Their Targets," *Annu. Rev. Cell Dev. Biol.* (2002) 18:495-513.

McManus, M. T. et al., "Gene silencing using micro-RNA designed hairpins," *RNA* (2002) 8(6):842-850.

Zeng, Y. et al., "Both Natural and Designed Micro RNAs Can Inhibit the Expression of Cognate mRNAs When Expressed in Human Cells," *Mol. Cell.* (2002) 9(6):1327-1333.

Lagos-Quintana, M. et al., "Identification of Tissue-Specific MicroRNAs from Mouse," *Curr. Biol,* (2002) 12(9):735-739.

Pasquinelli, A. E., "MicroRNAs: deviants no longer," *Trends Genet.* (2002) 18(4):171-173.

Mourelatos, Z. et al., "miRNPs: a novel class of ribonucleoproteins containing numerous microRNAs," *Genes Dev.* (2002) 16(6):720-728.

Lai, E. C., "Micro RNAs are complementary to 3' UTR sequence motifs that mediate negative post-transcriptional regulation," *Nat Genet.* (2002) 30(4):363-364.

Ambros, V., "microRNAs: Tiny Regulators with Great Potential," *Cell* (2001) 107(7):823-826.

Novina, C. D. et al., "The RNAi revolution," *Nature* (2004) 430(6996):161-164.

Bonnet, E. et al., "Evidence that microRNA precursors, unlike other non-coding RNAs, have lower folding free energies than random sequences," *Bioinformatics* (2004) 20(17):2911-2917.

He, L. et al., "MicroRNAs: Small RNAs With a Big Role in Gene Regulation," *Nat. Rev. Genet.* (2004) 5(7):522-531.

Scherr, M. et al., "RNAi in functional genomics," *Curr. Opin. Mol. Ther*, (2004) 6(2):129-135.

Suh, M. R. et al., "Human embryonic stem cells express a unique set of microRNAs," *Dev. Biol.* (2004) 270(2):488-498.

Takamizawa, J. et al., "Reduced Expression of the *let-7* MicroRNAs in Human Lung Cancers in Association with Shortened Postoperative Survival," *Cancer Res.* (2004) 64(11):3753-3756.

Murchison, E. P. et al., "miRNAs on the move: miRNA biogenesis and the RNAi machinery," *Curr. Opin. Cell Biol.* (2004) 16(3):223-229.

Bartel, D. P. et al., "Micromanagers of gene expression: the potentially widespread influence of metazoan microRNAs," *Nat. Rev. Genet.* (2004) 5(5):396-400.

Kim, V. N., "MicroRNA precursors in motion: exportin-5 mediates their nuclear export," *Trends Cell Biol.* (2004) 14(4):156-159.

Kiriakidou, M. et al., "A combined computational-experimental approach predicts human microRNA targets," *Genes Dev.* (2004) 18(10):1165-1178.

Chapman, E. J. et al., "Viral RNA silencing suppressors inhibit the microRNA pathway at an intermediate step," *Genes Dev.* (2004) 18(10):1179-1186.

Pfeffer, S. et al., "Identification of Virus-Encoded MicroRNAs," *Science* (2004) 304(5671):734-736.

Yekta, S. et al., "MicroRNA-Directed Cleavage of *HOXB8* mRNA," *Science* (2004) 304(5670):594-596.

Ambros, V. et al., "Identification of microRNAs and Other Tiny Noncoding RNAs by cDNA Cloning," *Methods Mol. Biol.* (2004) 265:131-158.

Lee, Y. S. et al., "Distinct Roles for *Drosophila* Dicer-1 and Dicer-2 in the siRNA/miRNA Silencing Pathways," *Cell* (2004) 117(1):69-81.

Tijsterman, M. et al., "Dicers at RISC: The Mechanism of RNAi," *Cell* (2004) 117(1):1-3.

Kawasaki, H. et al., "World of small RNAs: from ribozymes to siRNA and miRNA," *Differentiation* (2004) 72(2-3):58-64.

Ruvkun, G. et al., "The 20 Years It Took to Recognize the Importance of Tiny RNAs," *Cell* (2004) S116:S93-S96.

Lee, R. et al., "A Short history of a Short RNA," *Cell* (2004) S116:S89-S92.

Hutvagner, G. et al., "Sequence-Specific Inhibition of Small RNA Function," *PLoS Biol.* (2004) 2(4):0001-0011.

Matzke, M. et al., "Genetic analysis of RNA-mediated transcriptional gene silencing," *Biochim. Biophys. Acta.* (2004) 1677(1-3):129-141.

Rajewsky, N. et al., "Computational identification of microRNA targets," *Dev. Biol.* (2004) 267(2):529-535.

Sempere, L. F. et al., "Expression profiling of mammalian microRNAs uncovers a subset of brain-expressed microRNAs with possible roles in murine and human neuronal differentiation," *Genome Biol.* (2004) 5(3):R13.

Siomi, H. et al., "RNA Interference: A New Mechanism by Which FMRP Acts in the Normal Brain? What Can Drosophila Teach Us?" *Ment. Retard. Dev. Disabil. Res. Rev.* (2004) 10(1):68-74.

Katayama, K. et al., "RNA interfering approach for clarifying the PPARγ pathway using lentiviral vector expressing short hairpin RNA," *FEBS Lett.* (2004) 560(1-3):178-182.

Carmell, M. A. et al., "RNase III enzymes and the initiation of gene silencing," *Nat. Struct. Mol. Biol.* (2004) 11(3):214-218.

Calin, G. A. et al., "Human microRNA genes are frequently located at fragile sites and genomic regions involved in cancers," *PNAS* (2004) 101(9):2999-3004.

Meister, G. et al., "Sequence-specific inhibition of microRNA- and siRNA-induced RNA silencing," *RNA* (2004) 10(3):544-550.

Nelson, P. T. et al., "miRNP:mRNA association in polyribosomes in a human neuronal cell line," *RNA* (2004) 10(3):387-394.

Boden, D. et al., "Enhanced gene silencing of HIV-1 specific siRNA using microRNA designed hairpins," *Nucleic Acids Res.* (2004) 32(3):1154-1158.

Huang, A. et al., "Functional silencing of hepatic microsomal glucose-6-phosphatase gene expression in vivo by adenovirus-mediated delivery of short hairpin RNA," *FEBS Lett.* (2004) 558(1-3):69-73.

Bartel, D. P., "MicroRNAs: Genomics, Biogenesis, Mechanism, and Function," *Cell* (2004) 116(2):281-297.

Bohnsack, M. T. et al., "Exportin 5 is a RanGTP-dependent dsRNA-binding protein that mediates nuclear export of pre-miRNAs," *RNA* (2004) 10(2):185-191.

Lai, E. C. et al. "Complementary miRNA pairs suggest a regulatory role for miRNA:miRNA duplexes," *RNA* (2004) 10(2):171-175.

Jin, P. et al., "Biochemical and genetic interaction between the fragile X mental retardation protein and the microRNA pathway," *Nat. Neurosci.* (2004) 7(2):113-117.

Lewis, B. P. et al., "Prediction of Mammalian MicroRNA Targets," *Cell* (2003) 115(7):787-798.

Metzler, M. et al., "High Expression of Precursor MicroRNA-155/ BIC RNA in Children with Burkitt Lymphoma," *Genes Chromosomes Cancer* (2004) 39(2):167-169.

Kim, J. et al., "Identification of many microRNAs that copurify with polyribosomes in mammalian neurons," *PNAS* (2004) 101(1):360-365.

Griffiths-Jones, S. "The microRNA Registry," *Nucleic Acids Res.* (2004) 32 Database issue:D109-111.

Chen, C. Z. et al., "MicroRNAs Modulate Hematopoietic Lineage Differentiation," *Science* (2004) 303(5654):83-86.

Lund, E. et al., "Nuclear Export of MicroRNA Precursors," *Science* (2004) 303(5654):95-98. Epub Nov. 20, 2003.

Basyuk, E. et al., "Human let-7 stem-loop precursors harbor features of RNase III cleavage products," *Nucleic Acids Res.* (2003) 31(22):6593-6597.

Michael, M. Z. et al., "Reduced Accumulation of Specific MicroRNAs in Colorectal Neoplasia," *Mol. Cancer Res.* (2003) 1(12):882-891.

Khvorova, A. et al., "Functional siRNAs and miRNAs Exhibit Strand Bias," *Cell* (2003) 115(2):209-216.

McManus, M. T., "MicroRNAs and cancer," *Semin. Cancer Biol.* (2003) 13(4):253-258.

Lee, Y. et al., "The nuclear RNase III Drosha initiates microRNA processing," *Nature* (2003) 425(6956):415-419.

Bergmann, A. et al., "HIDden targets of microRNAs for growth control," *Trends Biochem. Sci.* (2003) 28(9):461-463.

Ke, X. S. et al., "MicroRNAs: key participants in gene regulatory networks," *Curr. Opin. Chem. Biol.* (2003) 7(4):516-523.

Boutla, A. et al., "Developmental defects by antisense-mediated inactivation of micro-RNAs 2 and 13 in *Drosophila* and the identification of putative target genes," *Nucleic Acids Res.* (2003) 31(17):4973-4980.

Houbaviy, H. B. et al., "Embryonic Stem Cell-Specific MicroRNAs," *Dev. Cell.* (2003) 5(2):351-358.

Schramke, V. et al., "Hairpin RNAs and Retrotransposon LTRs Effect RNAi and Chromatin-Based Gene Silencing," *Science* (2003) 301(5636):1069-1074.

Zeng, Y. et al., "MicroRNAs and small interfering RNAs can inhibit mRNA expression by similar Mechanisms," *PNAS* (2003) 100(17):9779-9784.

Baker, B. et al., "2'-O-(2-Methoxy)ethyl-modified anti-intercellular adhesion molecule 1 (ICAM-1)oligonucleotides selectively increase the ICAM-1 mRNA level and inhibit formation of the ICAM-1 translation initiation complex in human umbilical vein endothelial cells", J Biol Chem. (May 2, 1997);272(18):11994-2000.

Karras, J. G. et al., "Deletion of individual exons and induction of soluble murine interleukin-5 receptor-alpha chain expression through antisense oligonucleotide-mediated redirection of pre-mRNA splicing", Mol Pharmacol. (Aug. 2000);58(2);380-7.

Mercatante, D. R. et al., Modification of alternative splicing by antisense oligonucleotides as apotential chemotherapy for cancer and other diseases, Curr Cancer Drug Targets. (Nov. 2001);1(3):211-30.

Monia, B. P. et al., Evaluation of 2'-modified oligonucleotides containing 2'-deoxy gaps as antisense inhibitors of gene expression, J Biol Chem. (Jul. 5, 1993);268(19):14514-22.

PCT International Search Report dated Dec. 13, 2005 for application No. PCT/US2004/025300.

PCT Written Opinion dated Dec. 13, 2005 for application No. PCT/US2004/025300.

* cited by examiner

ERK5 nucleotides (nts) 937-966     ERK5 nts 2041-2070     ERK5 nts 2163-2192

($\Delta G°_{37}$ =−22.8)     ($\Delta G°_{37}$ =−20.6)     ($\Delta G°_{37}$ =−19.3)

Bimolecular hybridization free energies ($\Delta G°_{37}$) of the interaction of the mir-143 miRNA (SEQ ID NO: 220) with three novel binding sites in the coding sequence of the ERK5 mRNA (GenBank Accession NM_139032.1; SEQ ID NO: 861).

OLIGOMERIC COMPOUNDS AND COMPOSITIONS FOR USE IN MODULATION OF SMALL NON-CODING RNAS

CROSS-REFERENCE TO RELATED APPLICATIONS

This application claims priority to U.S. provisional applications Ser. No. 60/492,056 filed Jul. 31, 2003, Ser. No. 60/516,303 filed Oct. 31, 2003, Ser. No. 60/531,596 filed Dec. 19, 2003, and Ser. No. 60/562,417 filed Apr. 14, 2004, each which is incorporated herein by reference in its entirety.

FIELD OF THE INVENTION

The present invention provides compositions and methods for modulation of small non-coding RNAs. In particular, this invention relates to compounds, particularly oligomeric compounds, which, in some embodiments, hybridize with or sterically interfere with nucleic acid molecules comprising or encoding small non-coding RNA targets. Such compounds are shown herein to modulate the levels of small non-coding RNAs. The oligomeric compounds of the invention may include one or more modifications thereon resulting in differences in physical or chemical properties compared to unmodified nucleic acids. These modified oligomeric compounds are used as single compounds or in compositions to modulate or mimic the targeted nucleic acid comprising or encoding the small non-coding RNA. In some embodiments of the invention, modifications include chemical modifications that improve activity of the oligomeric compound. In some embodiments, the modifications include moieties that modify or enhance the pharmacokinetic or pharmacodynamic properties, stability or nuclease resistance of the oligomeric compound. In some embodiments, the modifications render the oligomeric compounds capable of sterically interfering with the natural processing of the nucleic acids comprising or encoding the small non-coding RNA targets.

BACKGROUND OF THE INVENTION

RNA genes were once considered relics of a primordial "RNA world" that was largely replaced by more efficient proteins. More recently, however, it has become clear that non-coding RNA genes produce functional RNA molecules with important roles in regulation of gene expression, developmental timing, viral surveillance, and immunity. Not only the classic transfer RNAs (tRNAs) and ribosomal RNAs (rRNAs), but also small nuclear RNAs (snRNAs), small nucleolar RNAs (snoRNAs), small interfering RNAs (siRNAs), tiny non-coding RNAs (tncRNAs), repeat-associated small interfering RNAs (rasiRNAs) and microRNAs (miRNAs) are now believed to act in diverse cellular processes such as chromosome maintenance, gene imprinting, pre-mRNA splicing, guiding RNA modifications, transcriptional regulation, and the control of mRNA translation (Eddy, Nat. Rev. Genet., 2001, 2, 919-929; Kawasaki and Taira, Nature, 2003, 423, 838-842; Aravin, et al., Dev. Cell, 2003, 5, 337-350). RNA-mediated processes are now also believed to direct heterochromatin formation, genome rearrangements, and DNA elimination (Cerutti, Trends Genet., 2003, 19, 39-46; Couzin, Science, 2002, 298, 2296-2297).

The recently described phenomenon known as RNA interference (RNAi) is involves the processing of double stranded RNA into siRNAs by an RNase III-like dsRNA-specific enzyme known as Dicer (also known as helicase-moi) which are then incorporated into a ribonucleoprotein complex, the RNA-induced silencing complex (RISC). RISC is believed to use the siRNA molecules as a guide to identify complementary RNAs, and an endoribonuclease (to date unidentified) cleaves these target RNAs, resulting in their degradation (Cerutti, Trends Genet., 2003, 19, 39-46; Grishok et al., Cell, 2001, 106, 23-34). In addition to the siRNAs, a large class of small non-coding RNAs known as microRNAs (miRNAs, originally termed stRNA for "short temporal RNAs") is believed to play a role in regulation of gene expression employing some of the same players involved in the RNAi pathway (Novina and Sharp, Nature, 2004, 430, 161-164).

Like siRNAs, miRNAs are believed to be processed endogenously by the Dicer enzyme, and are approximately the same length, and possess the characteristic 5'-phosphate and 3'-hydroxyl termini. The miRNAs are also incorporated into a ribonucleoprotein complex, the miRNP, which is similar, and may be identical to the RISC (Bartel and Bartel, Plant Physiol., 2003, 132, 709-717). More than 200 different miRNAs have been identified in plants and animals (Ambros et al., Curr. Biol., 2003, 13, 807-818).

In spite of their biochemical and mechanistic similarities, there are also some differences between siRNAs and miRNAs, based on unique aspects of their biogenesis. siRNAs are generated from the cleavage of long exogenous or possibly endogenous dsRNA molecules, such as very long hairpins or bimolecular duplexed dsRNA, and numerous siRNAs accumulate from both strands of dsRNA precursors. In contrast, mature miRNAs appear to originate from long endogenous primary miRNA transcripts (also known as pri-miRNAs, pri-mirs or pri-pre-miRNAs) that are often hundreds of nucleotides in length (Lee, et al., EMBO J., 2002, 21(17), 4663-4670).

The current model of miRNA processing involves primary miRNA transcripts being processed by a nuclear enzyme in the RNase III family known as Drosha, into approximately 70 nucleotide-long pre-miRNAs (also known as stem-loop structures, hairpins, pre-mirs or foldback miRNA precursors) which are subsequently processed by the Dicer RNase into mature miRNAs, approximately 21-25 nucleotides in length. It is believed that, in processing the pri-miRNA into the pre-miRNA, the Drosha enzyme cuts the pri-miRNA at the base of the mature miRNA, leaving a 2-nt 3' overhang (Ambros et al., RNA, 2003, 9, 277-279; Bartel and Bartel, Plant Physiol., 2003, 132, 709-717; Shi, Trends Genet., 2003, 19, 9-12; Lee, et al., EMBO J., 2002, 21(17), 4663-4670; Lee, et al., Nature, 2003, 425, 415-419). The 3' two-nucleotide overhang structure, a signature of RNaseIII cleavage, has been identified as a critical specificity determinant in targeting and maintaining small RNAs in the RNA interference pathway (Murchison, et al., Curr. Opin. Cell Biol., 2004, 16, 223-9). Both the primary RNA transcripts (pri-miRNAs) and foldback miRNA precursors (pre-miRNAs) are believed to be single-stranded RNA molecules with at least partial double-stranded character, often containing smaller, local internal hairpin structures. Primary miRNA transcripts may be processed such that one single-stranded mature miRNA molecule is generated from one arm of the hairpin-like structure of the pri-miRNA. Alternatively, a polycistronic pri-miRNA may contain multiple pre-miRNAs, each processed into a different, single-stranded mature miRNA.

Naturally occurring miRNAs are characterized by imperfect complementarity to their target sequences. Artificially modified miRNAs with sequences completely complementary to their target RNAs have been designed and found to function as double stranded siRNAs that inhibit gene expression by reducing RNA transcript levels. Synthetic hairpin RNAs that mimic siRNAs and miRNA precursor molecules were demonstrated to target genes for silencing by degradation and not translational repression (McManus et al., RNA, 2002, 8, 842-850).

Tiny non-coding RNA (tncRNA), one class of small non-coding RNAs (Ambros et al., Curr. Biol., 2003, 13, 807-818) produce transcripts similar in length (20-21 nucleotides) to miRNAs, and are also thought to be developmentally regulated but, unlike miRNAs, tncRNAs are reportedly not processed from short hairpin precursors and are not phylogenetically conserved. Although none of these tncRNAs are reported to originate from miRNA hairpin precursors, some are predicted to form potential foldback structures reminiscent of pre-miRNAs; these putative tncRNA precursor structures deviate significantly from those of pre-miRNAs in key characteristics, i.e., they exhibit excessive numbers of bulged nucleotides in the stem or have fewer than 16 base pairs involving the small RNA (Ambros et al., Curr. Biol., 2003, 13, 807-818).

Recently, another class of small non-coding RNAs, the repeat-associated small interfering RNAs (rasiRNAs) has been isolated from *Drosophila melanogaster*. The rasiRNAs are associated with repeated sequences, transposable elements, satellite and microsatellite DNA, and Suppressor of Stellate repeats, suggesting that small RNAs may participate in defining chromatin structure (Aravin, et al., Dev. Cell, 2003, 5, 337-350).

A total of 201 different expressed RNA sequences potentially encoding novel small non-messenger species (smnRNAs) has been identified from mouse brain cDNA libraries. Based on sequence and structural motifs, several of these have been assigned to the snoRNA class of nucleolar localized molecules known to act as guide RNAs for rRNA modification, whereas others are predicted to direct modification within the U2, U4, or U6 small nuclear RNAs (snRNAs). Some of these newly identified smnRNAs remained unclassified and have no identified RNA targets. It was suggested that some of these RNA species may have novel functions previously unknown for snoRNAs, namely the regulation of gene expression by binding to and/or modifying mRNAs or their precursors via their antisense elements (Huttenhofer et al., Embo J., 2001, 20, 2943-2953).

To date, the binding and regulatory sites within nucleic acid targets of the small non-coding RNAs are largely unknown, although a few putative motifs have been suggested to exist in the 3'UTR of certain genes (Lai and Posakony, Development, 1997, 124, 4847-4856; Lai, et al., Development, 2000, 127, 291-306; Lai, Nat Genet. 2002, 30(4), 363-364).

One miRNA is also believed to act as a cell death regulator, implicating it in mechanisms of human disease such as cancer. Recently, the *Drosophila* mir-14 miRNA was identified as a suppressor of apoptotic cell death and is required for normal fat metabolism. (Xu et al., Curr. Biol., 2003, 13, 790-795).

Downregulation or deletion of other miRNAs has been associated with B-cell chronic lymphocytic leukemia (B-CLL) (Calin et al., Proc. Natl. Acad. Sci. USA, 2002, 99, 15524-15529), and human homologues of the murine mir-143 and mir-145 mature miRNAs were recently reported to be expressed and processed at reduced steady-state levels at the adenomatous and cancerous stages of colorectal neoplasia (Michael, et al., Mol. Cancer Res., 2003, 1, 882-891).

Expression of the human mir-30 miRNA specifically blocked the translation in human cells of an mRNA containing artificial mir-30 target sites. In these studies, putative miRNAs were excised from transcripts encompassing artificial miRNA precursors and could inhibit the expression of mRNAs containing a complementary target site. These data indicate that novel miRNAs can be readily produced in vivo and can be designed to specifically inactivate the expression of selected target genes in human cells (Zeng et al., Mol. Cell, 2002, 9, 1327-1333).

Disclosed and claimed in PCT Publication WO 03/029459 are miRNAs from several species, or a precursor thereof; a nucleotide sequence which is the complement of said nucleotide sequence which has an identity of at least 80% to said sequence; and a nucleotide sequence which hybridizes under stringent conditions to said sequence. Also claimed is a pharmaceutical composition containing as an active agent at least one of said nucleic acid and optionally a pharmaceutically acceptable carrier, and a method of identifying microRNA molecules or precursor molecules thereof comprising ligating 5'-and 3'-adapter molecules to the ends of a size-fractionated RNA population, reverse transcribing said adapter containing RNA population and characterizing the reverse transcription products (Tuschl et al., Genes Dev., 1999, 13, 3191-3197).

Small non-coding RNA-mediated regulation of gene expression is an attractive approach to the treatment of diseases as well as infection by pathogens such as bacteria, viruses and prions and other disorders associated with RNA expression or processing.

Consequently, there remains a long-felt need for agents that regulate gene expression via the mechanisms mediated by small non-coding RNAs. Identification of modified miRNAs or miRNA mimics that can increase or decrease gene expression or activity is therefore desirable.

The present invention therefore provides oligomeric compounds and methods useful for modulating gene levels, expression, function or pathways, including those relying on mechanisms of action such as RNA interference and dsRNA enzymes, as well as antisense and non-antisense mechanisms. One having skill in the art, once armed with this disclosure will be able, without undue experimentation, to identify compounds, compositions and methods for these uses.

SUMMARY OF THE INVENTION

The present invention provides oligomeric compounds, especially nucleic acid and nucleic acid-like oligomers, which are targeted to or mimic nucleic acids comprising or encoding small non-coding RNAs, and which act to modulate the levels of small non-coding RNAs, or interfere with their function.

The present invention also provides oligomeric compounds comprising a first strand and a second strand wherein at least one strand contains a modification and wherein a portion of one of the oligomeric compound strands is capable of hybridizing to a small non-coding RNA target nucleic acid.

The present invention also provides oligomeric compounds comprising a first region and a second region and optionally a third region wherein at least one region contains a modification and wherein a portion of the oligomeric compound is capable of hybridizing to a small non-coding RNA target nucleic acid.

The present invention also provides oligomeric compounds, especially nucleic acid and nucleic acid-like oligomers, which are targeted to a nucleic acid encoding human Dicer, and which act to modulate the levels of the human Dicer RNase III enzyme and interfere with its function, as well as modulating the levels of small non-coding RNAs.

Pharmaceutical and other compositions comprising the compounds of the invention are also provided.

Also provided are methods of screening for modulators of small non-coding RNAs and methods of modulating the levels of small non-coding RNAs in cells, tissues or animals comprising contacting said cells, tissues or animals with one or more of the compounds or compositions of the invention.

Methods of treating an animal, particularly a human, suspected of having or being prone to a disease or condition associated with expression of small non-coding RNAs are also set forth herein. Such methods comprise optionally identifying such an animal, and administering a therapeutically or prophylactically effective amount of one or more of the compounds or compositions of the invention to the animal or person.

DETAILED DESCRIPTION OF THE INVENTION

Figure 1:
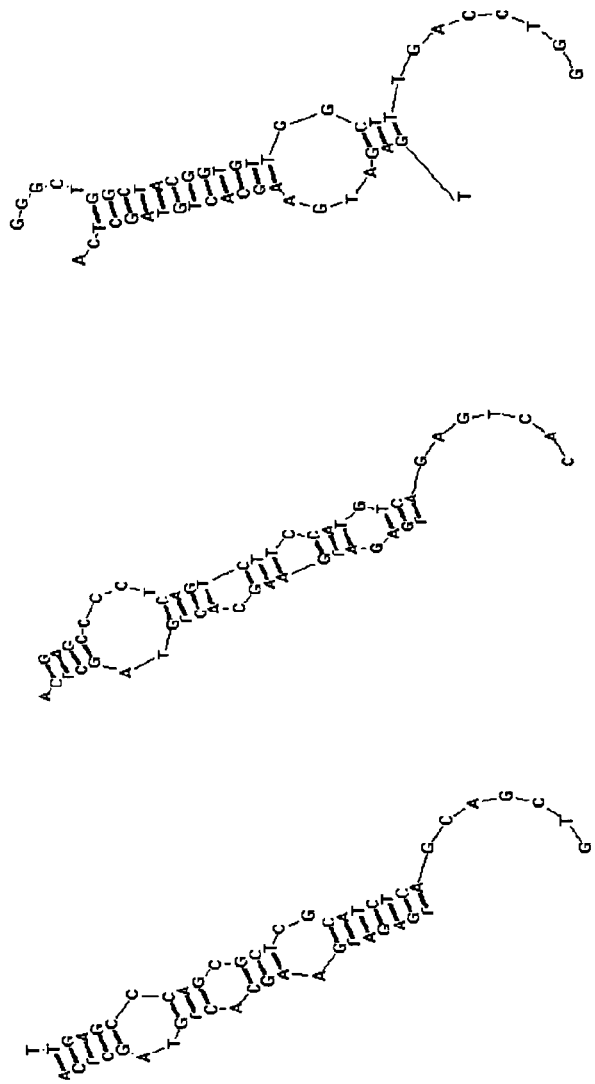
FIG. 1 shows the interaction of the mir-143 miRNA with three novel binding sites in the ERK5 mRNA coding sequence (GenBank Accession NM_139032.1) identified herein, along with their bimolecular hybridization free energies.

The present invention provides oligomeric compounds useful in, for example, the modulation of expression, endogenous levels or the function of small non-coding RNAs. As used herein, the term "small non-coding RNA" is used to encompass, without limitation, a polynucleotide molecule ranging from about 17 to about 450 nucleotides in length, which can be endogenously transcribed or produced exogenously (chemically or synthetically), but is not translated into a protein. Small non-coding RNAs may include isolated single-, double-, or multiple-stranded molecules, any of which may include regions of intrastrand nucleobase complementarity, said regions capable of folding and forming a molecule with fully or partially double-stranded or multiple-stranded character based on regions of perfect or imperfect complementarity. Examples of small non-coding RNAs include, but are not limited to, primary miRNA transcripts (also known as pri-pre-miRNAs, pri-mirs and pri-miRNAs, which range from around 70 nucleotides to about 450 nucleotides in length and often taking the form of a hairpin structure); pre-miRNAs (also known as pre-mirs and foldback miRNA precursors, which range from around 50 nucleotides to around 110 nucleotides in length); miRNAs (also known as microRNAs, Mirs, miRs, mirs, and mature miRNAs, and generally refer either to double-stranded intermediate molecules around 17 to about 25 nucleotides in length, or to single-stranded miRNAs, which may comprise a bulged structure upon hybridization with a partially complementary target nucleic acid molecule); or mimics of pri-miRNAs, pre-miRNAs or miRNAs. Small non-coding RNAs can be endogenously transcribed in cells, or can be synthetic oligonucleotides, in vitro transcribed polynucleotides or nucleic acid oligomeric compounds expressed from vectors. Pri-miRNAs and pre-miRNAs, or mimics thereof, may be processed into smaller molecules.

As used herein, the term "miRNA precursor" is used to encompass, without limitation, primary RNA transcripts, pri-miRNAs and pre-miRNAs.

In some embodiments, pri-miRNAs, or mimics thereof, are 70 to 450 nucleobases in length. One having ordinary skill in the art will appreciate that this embodies oligomeric compounds of 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449 or 450 nucleobases in length, or any range therewithin.

In some embodiments, pri-miRNAs, or mimics thereof, are 110 to 430 nucleobases in length. One having ordinary skill in the art will appreciate that this embodies oligomeric compounds of 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429 or 430 nucleobases in length, or any range therewithin.

In some embodiments, pri-miRNAs, or mimics thereof, are 110 to 280 nucleobases in length. One having ordinary skill in the art will appreciate that this embodies oligomeric compounds of 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279 or 280 nucleobases in length, or any range therewithin.

In some embodiments, pre-miRNAs, or mimics thereof, are 50 to 110 nucleobases in length. One having ordinary skill in the art will appreciate that this embodies oligomeric compounds of 50, 51, 52, 53, 54, 55, 56, 57, 58, 59, 60, 61, 62, 63, 64, 65, 66, 67, 68, 69 70, 71 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109 or 110 nucleobases in length, or any range therewithin. In some embodiments, pre-miRNAs, or mimics thereof, are 60 to 80 nucleobases in length. One having ordinary skill in the art will appreciate that this embodies oligomeric compounds of 60, 61, 62, 63, 64, 65, 66, 67, 68, 69, 70, 71, 72, 73, 74, 75, 76, 77, 78, 79, or 80 nucleobases in length, or any range therewithin.

In some embodiments, miRNAs, or mimics thereof, are 15 to 49 nucleobases in length. One having ordinary skill in the art will appreciate that this embodies oligomeric compounds of 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleobases in length, or any range therewithin. In some embodiments, miRNAs, or mimics thereof, are 17 to 25 nucleobases in length. One having ordinary skill in the art will appreciate that this embodies oligomeric compounds of 17, 18, 19, 20, 21, 22, 23, 24 or 25 nucleobases in length, or any range therewithin.

Oligomeric compounds of the invention modulate the levels, expression or function of small non-coding RNAs by hybridizing to a nucleic acid comprising or encoding a small non-coding RNA nucleic acid target resulting in alteration of normal function by, for example, facilitating destruction of the small non-coding RNA through cleavage, by sequestration, or by sterically occluding the function of the small non-coding RNA. Further, modified synthetic oligomeric compounds of the present invention may be designed to mimic endogenous small non-coding RNAs. These modifications include, but are not limited to, improved pharmacokinetic or pharmacodynamic properties, binding affinity, stability, charge, localization or uptake. Synthetic mimics can therefore act as replacements for small non-coding RNAs, as competitive inhibitors of naturally occuring small non-coding RNAs or as delivery systems wherein the mimic construct contains one or more functional components.

As used herein, the terms "target nucleic acid," "target RNA," "target RNA transcript" or "nucleic acid target" are used to encompass any nucleic acid capable of being targeted including, without limitation, RNA (including microRNAs, stRNAs, small nuclear RNAs, small nucleolar RNAs, small ribosomal RNAs, small hairpin RNAs, endogenous antisense RNAs, guide RNAs, tiny noncoding RNAs, small single or double stranded RNAs that are encoded by heterochromatic repeats at centromeres or other chromosomal origin, and any precursors thereof). These nucleic acid targets can be coding or non-coding sequences; pre-mRNAs or mRNAs; single- or double-stranded, or single-stranded with partial double-stranded character; may occur naturally within introns or exons of messenger RNAs (mRNAs), ribosomal RNAs (rRNAs), or transfer RNAs (tRNAs); and can be endogenously transcribed or exogenously produced.

In some embodiments of this invention, modulation of small non-coding RNA levels, expression or function is achieved via oligomeric compounds which target a further RNA associated with the particular small non-coding RNA. This association can be a physical association between that RNA and the particular small non-coding RNA such as, but not limited to, in an RNA or ribonucleoprotein complex. This association can also be within the context of a biological pathway, such as but not limited to, the regulation of levels, expression or function of a protein-encoding mRNA or its precursor by a small non-coding RNA. As such, the invention provides for modulation of the levels, expression or function of a target nucleic acid where the target nucleic acid is a messenger RNA whose expression levels and/or function are associated with one or more small non-coding RNAs. The messenger RNA function or processing may be disrupted by degradation through an antisense mechanism, including but not limited to, RNA interference, or RNase H, as well as other mechanisms wherein double stranded nucleic acid structures are recognized and degraded, cleaved, sterically occluded, sequestered or otherwise rendered inoperable.

The compounds or compositions of the present invention may also interfere with the function of endogenous RNA molecules. The functions of RNA to be interfered with can include, for example, nuclear events such as replication or transcription as the compounds of the present invention could target or mimic small non-coding RNAs in these cellular processes. Replication and transcription, for example, can be from an endogenous cellular template, a vector, a plasmid construct or otherwise. The functions of RNA to be interfered with can include cytoplasmic events such as translocation of the RNA to a site of protein translation, translocation of the RNA to sites within the cell which are distant from the site of RNA synthesis, translation of protein from the RNA, splicing of the RNA to yield one or more RNA species, RNA signaling and regulatory activities, and catalytic activity or complex formation involving the RNA which may be engaged in or facilitated by the RNA as the compounds of the present invention could target or mimic small non-coding RNAs in these cellular processes.

In the context of the present invention, "modulation" and "modulation of expression" mean either an increase (stimulation) or a decrease (inhibition) in the amount or levels of a small non-coding RNA, nucleic acid target, an RNA or protein associated with a small non-coding RNA, or a downstream target of the small non-coding RNA (e.g., a mRNA representing a protein-coding nucleic acid that is regulated by a small non-coding RNA). Inhibition is a suitable form of modulation and small non-coding RNA is a suitable target nucleic acid.

In the context of the present invention, "modulation of function" means an alteration in the function of the small non-coding RNA or an alteration in the function of any cellular component with which the small non-coding RNA has an association or downstream effect.

The present invention provides, inter alia, oligomeric compounds and compositions containing the same wherein the oligomeric compound includes one or more modifications that render the compound capable of supporting modulation of the levels, expression or function of the small non-coding RNA by a degradation or cleavage mechanism.

The present invention also provides methods of maintaining a pluripotent stem cell comprising contacting the cell with an effective amount of an oligomeric compound targeting human Dicer. The pluripotent stem cell can be present in a sample of cord blood or bone marrow, or may be present as part of a cell line. In addition, the pluripotent stem cell can be an embryonic stem cell.

The present invention also provides oligomeric compounds and compositions containing the same wherein the oligomeric compound includes one or more modifications that render the compound capable of blocking or interfering with the levels, expression or function of one or more small non-coding RNAs by steric occlusion.

The present invention also provides oligomeric compounds and compositions containing the same wherein the oligomeric compound includes one or more modifications or structural elements or motifs that render the compound capable of mimicking or replacing one or more small non-coding RNAs.

Oligomeric Compounds

In the context of the present invention, the term "oligomeric compound(s)" refers to polymeric structures which are capable of hybridizing to at least a region of a small non-coding RNA molecule or a target of small non-coding RNAs, or polymeric structures which are capable of mimicking small non-coding RNAs. The term "oligomeric compound" includes, but is not limited to, compounds comprising oligonucleotides, oligonucleosides, oligonucleotide analogs, oligonucleotide mimetics and combinations of these. Oligomeric compounds also include, but are not limited to, antisense oligomeric compounds, antisense oligonucleotides, siRNAs, alternate splicers, primers, probes and other compounds that hybridize to at least a portion of the target nucleic acid. Oligomeric compounds are routinely prepared linearly but can be joined or otherwise prepared to be circular and may also include branching. Separate oligomeric compounds can hybridize to form double stranded compounds that can be blunt-ended or may include overhangs on one or both termini. In general, an oligomeric compound comprises a backbone of linked monomeric subunits where each linked monomeric subunit is directly or indirectly attached to a heterocyclic base moiety. The linkages joining the monomeric subunits, the sugar moieties or sugar surrogates and the heterocyclic base moieties can be independently modified giving rise to a plurality of motifs for the resulting oligomeric compounds including hemimers, gapmers and chimeras.

As is known in the art, a nucleoside is a base-sugar combination. The base portion of the nucleoside is normally a heterocyclic base moiety. The two most common classes of such heterocyclic bases are purines and pyrimidines. Nucleotides are nucleosides that further include a phosphate group covalently linked to the sugar portion of the nucleoside. For those nucleosides that include a pentofuranosyl sugar, the phosphate group can be linked to either the 2', 3' or 5' hydroxyl moiety of the sugar. In forming oligonucleotides, the phosphate groups covalently link adjacent nucleosides to one another to form a linear polymeric compound. The respective ends of this linear polymeric structure can be joined to form a circular structure by hybridization or by formation of a covalent bond. In addition, linear compounds may have internal nucleobase complementarity and may therefore fold in a manner as to produce a fully or partially double-stranded structure. Within the oligonucleotide structure, the phosphate groups are commonly referred to as forming the internucleoside linkages of the oligonucleotide. The normal internucleoside linkage of RNA and DNA is a 3' to 5' phosphodiester linkage.

In the context of this invention, the term "oligonucleotide" refers generally to an oligomer or polymer of ribonucleic acid (RNA) or deoxyribonucleic acid (DNA). This term includes oligonucleotides composed of naturally occurring nucleobases, sugars and covalent internucleoside linkages. The term "oligonucleotide analog" refers to oligonucleotides that have one or more non-naturally occurring portions which function in a similar manner to oligonucleotides. Such non-naturally occurring oligonucleotides are often selected over naturally occurring forms because of desirable properties such as, for example, enhanced cellular uptake, enhanced affinity for other oligonucleotides or nucleic acid targets and increased stability in the presence of nucleases.

In the context of this invention, the term "oligonucleoside" refers to nucleosides that are joined by internucleoside linkages that do not have phosphorus atoms. Internucleoside linkages of this type include short chain alkyl, cycloalkyl, mixed heteroatom alkyl, mixed heteroatom cycloalkyl, one or more short chain heteroatomic and one or more short chain heterocyclic. These internucleoside linkages include but are not limited to siloxane, sulfide, sulfoxide, sulfone, acetyl, formacetyl, thioformacetyl, methylene formacetyl, thioformacetyl, alkenyl, sulfamate; methyleneimino, methylenehydrazino, sulfonate, sulfonamide, amide and others having mixed N, O, S and $CH_2$ component parts. In addition to the modifications described above, the nucleosides of the oligomeric compounds of the invention can have a variety of other modifications. Additional nucleosides amenable to the present invention having altered base moieties and or altered sugar moieties are disclosed in U.S. Pat. No. 3,687,808 and PCT application PCT/US89/02323.

For nucleotides that are incorporated into oligonucleotides of the invention, these nucleotides can have sugar portions that correspond to naturally occurring sugars or modified sugars. Representative modified sugars include carbocyclic or acyclic sugars, sugars having substituent groups at one or more of their 2', 3' or 4' positions and sugars having substituents in place of one or more hydrogen atoms of the sugar.

Altered base moieties or altered sugar moieties also include other modifications consistent with the spirit of this invention. Such oligomeric compounds are best described as being structurally distinguishable from, yet functionally interchangeable with, naturally occurring or synthetic unmodified oligonucleotides. All such oligomeric compounds are comprehended by this invention so long as they function effectively to mimic the structure or function of a desired RNA or DNA oligonucleotide strand.

A class of representative base modifications include tricyclic cytosine analog, termed "G clamp" (Lin, et al., *J. Am. Chem. Soc.* 1998, 120, 8531). This analog can form four hydrogen bonds with a complementary guanine (G) by simultaneously recognizing the Watson-Crick and Hoogsteen faces of the targeted G. This G clamp modification when incorporated into phosphorothioate oligomeric compounds, dramatically enhances potencies as measured by target reduction in cell culture. The oligomeric compounds of the invention also can include phenoxazine-substituted bases of the type disclosed by Flanagan, et al., Nat. Biotechnol. 1999, 17(1), 48-52.

The oligomeric compounds in accordance with this invention comprise from about 8 to about 80 monomeric subunits (i.e. from about 8 to about 80 linked nucleosides). One of ordinary skill in the art will appreciate that the invention embodies oligomeric compounds of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 subunits in length, or any range therewithin.

In one embodiment, the oligomeric compounds of the invention are 12 to 50 monomeric subunits in length. One having ordinary skill in the art will appreciate that this embodies oligomeric compounds of 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 subunits in length, or any range therewithin.

In one embodiment, the oligomeric compounds of the invention are 13 to 80 monomeric subunits in length. One having ordinary skill in the art will appreciate that this embodies oligomeric compounds of 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 subunits in length, or any range therewithin.

In one embodiment, the oligomeric compounds of the invention are 15 to 30 monomeric subunits in length. One having ordinary skill in the art will appreciate that this embodies oligomeric compounds of 15, 16, 17, 18, 19, 20, 21, 22, 23, 24, 25, 26, 27, 28, 29, or 30 subunits in length, or any range therewithin.

In one embodiment, the oligomeric compounds of the invention are 70 to 450 monomeric subunits in length. One having ordinary skill in the art will appreciate that this embodies oligomeric compounds of 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449 or 450 subunits in length, or any range therewithin.

In one embodiment, the oligomeric compounds of the invention are 110 to 430 monomeric subunits in length. One having ordinary skill in the art will appreciate that this embodies oligomeric compounds of 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429 or 430 subunits in length, or any range therewithin.

In one embodiment, the oligomeric compounds of the invention are 110 to 280 monomeric subunits in length. One having ordinary skill in the art will appreciate that this embodies oligomeric compounds of 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279 or 280 subunits in length, or any range therewithin.

In one embodiment, the oligomeric compounds of the invention are 50 to 110 monomeric subunits in length. One having ordinary skill in the art will appreciate that this embodies oligomeric compounds of 50, 51, 52, 53, 54, 55, 56, 57, 58, 59, 60, 61, 62, 63, 64, 65, 66, 67, 68, 69 70, 71 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109 or 110 subunits in length, or any range therewithin.

In one embodiment, the oligomeric compounds of the invention are 60 to 80 monomeric subunits in length. One having ordinary skill in the art will appreciate that this embodies oligomeric compounds of 60, 61, 62, 63, 64, 65, 66, 67, 68, 69, 70, 71, 72, 73, 74, 75, 76, 77, 78, 79, or 80 subunits in length, or any range therewithin.

In one embodiment, the oligomeric compounds of the invention are 15 to 49 monomeric subunits in length. One having ordinary skill in the art will appreciate that this embodies oligomeric compounds of 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 subunits in length, or any range therewithin.

In one embodiment, the oligomeric compounds of the invention are 17 to 25 subunits in length. One having ordinary skill in the art will appreciate that this embodies oligomeric compounds of 17, 18, 19, 20, 21, 22, 23, 24 or 25 subunits in length, or any range therewithin.

In accordance with the present invention, oligomeric compounds designed to mimic pri-miRNAs are from about 70 to about 450 monomeric subunits in length, or from about 110 to 430 subunits in length. Oligomeric compounds of the invention designed to mimic pre-miRNAs are from about 50 to about 110 monomeric subunits in length, or from about 60 to about 80 subunits in length. Oligomeric compounds of the invention designed to mimic mature miRNAs are from about 17 to about 25 monomeric subunits in length, and can be single- or double-stranded with either or both strands comprising from about 17 to about 25 subunits.

As used herein, the term "about" means ±5% of the variable thereafter.

The size or length of any oligomeric compound of the present invention, within any range cited herein, can be determined as follows:

Let R(n, n+m−1) be a region from a target nucleobase sequence, where "n" is the 5'-most nucleobase position of the region, where "n+m−1" is the 3'-most nucleobase position of the region and where "m" is the length of the region. A set "S(m)", of regions of length "m" is defined as the regions where n ranges from 1 to L−m+1, where L is the length of the target nucleic acid sequence and L>m. A set, "A", of all regions can be constructed as a union of the sets of regions for each length from where m is greater than or equal to a lower limit of any recited range (8 in this example) and is less than or equal to the upper limit of any recited range (80 in this example).

This set of regions can be represented using the following mathematical notation:

$$A = \bigcup_m S(m) \text{ where } m \in N \mid 8 \le m \le 80$$

and $$S(m) = \{R_{n,n+m-1} \mid n \in \{1, 2, 3, \ldots, L-m+1\}\}$$

where the mathematical operator | indicates "such that", where the mathematical operator ∈ indicates "a member of a set" (e.g. y ∈ Z indicates that element y is a member of set Z), where x is a variable, where N indicates all natural numbers, defined as positive integers, and where the mathematical operator ∪ indicates "the union of sets".

For example, the set of regions for m equal to 8, 20 and 80 can be constructed in the following manner. The set of regions, each 8 monomeric subunits in length, S(m=8), in a target nucleic acid sequence 100 subunits in length (L=100), beginning at position 1 (n=1) of the target nucleic acid sequence, can be created using the following expression:

$$S(8)=\{R_{1,8}|n\in\{1,2,3,\ldots,93\}\}$$

and describes the set of regions comprising nucleobases 1-8, 2-9, 3-10, 4-11, 5-12, 6-13, 7-14, 8-15, 9-16, 10-17, 11-18, 12-19, 13-20, 14-21, 15-22, 16-23, 17-24, 18-21-28, 22-29, 23-30, 24-31, 25-32, 26-33, 27-34, 28-35, 29-36, 30-37, 31-38, 32-39, 33-40, 34-41, 35-42, 36-43, 37-44, 38-45, 39-46, 40-47, 41-48, 42-49, 43-50, 44-51, 45-52, 46-53, 47-54, 48-55, 49-56, 50-57, 51-58, 52-59, 53-60, 54-61, 55-62, 56-63, 57-64, 58-65, 59-66, 60-67, 61-68, 62-69, 63-70, 64-71, 65-72, 66-73, 67-74, 68-75, 69-76, 70-77, 71-78, 72-79, 73-80, 74-81, 75-82, 76-83, 77-84, 78-85, 79-86, 80-87, 81-88, 82-89, 83-90, 84-91, 85-92, 86-93, 87-94, 88-95, 89-96, 90-97, 91-98, 92-99, 93-100.

An additional set for regions 20 monomeric subunits in length, in a target sequence 100 subunits in length, beginning at position 1 of the target nucleic acid sequence, can be described using the following expression:

$$S(20)=\{R_{1,20}|n\in\{1,2,3,\ldots,81\}\}$$

and describes the set of regions comprising nucleobases 1-20, 2-21, 3-22, 4-23, 5-24, 6-25, 7-26, 8-27, 9-28, 10-29, 11-30, 12-31, 13-32, 14-33, 15-34, 16-35, 17-36, 18-21-40, 22-41, 23-42, 24-43, 25-44, 26-45, 27-46, 28-47, 29-48, 30-49, 31-50, 32-51, 33-52, 34-53, 35-54, 36-55, 37-56, 38-57, 39-58, 40-59, 41-60, 42-61, 43-62, 44-63, 45-64, 46-65, 47-66, 48-67, 49-68, 50-69, 51-70, 52-71, 53-72, 54-73, 55-74, 56-75, 57-76, 58-77, 59-78, 60-79, 61-80, 62-81, 63-82, 64-83, 65-84, 66-85, 67-86, 68-87, 69-88, 70-89, 71-90, 72-91, 73-92, 74-93, 75-94, 76-95, 77-96, 78-97, 79-98, 80-99, 81-100.

An additional set for regions 80 monomeric subunits in length, in a target sequence 100 subunits in length, beginning at position 1 of the target nucleic acid sequence, can be described using the following expression:

$$S(80)=\{R_{1,80}|n\in\{1,2,3,\ldots,21\}\}$$

and describes the set of regions comprising nucleobases 1-80, 2-81, 3-82, 4-83, 5-84, 6-85, 7-86, 8-87, 9-88, 10-89, 11-90, 12-91, 13-92, 14-93, 15-94, 16-95, 17-96, 18-21-100.

The union of these aforementioned example sets and other sets for lengths from 10 to 19 and 21 to 79 can be described using the mathematical expression $$A = \bigcup_m S(m)$$

where ∪ represents the union of the sets obtained by combining all members of all sets.

Thus, in this example, A would include regions 1-8, 2-9, 3-10 . . . 93-100, 1-20, 2-21, 3-22 . . . 81-100, 1-80, 2-81, 3-82 . . . 21-100.

The mathematical expressions described herein define all possible target regions in a target nucleic acid sequence of any length L, where the region is of length m, and where m is greater than or equal to the lower limit and less than or equal to the upper limit of monomeric units, and where m is less than L, and where n is less than L−m+1.

In the context of this invention, "hybridization" means the pairing of complementary strands of oligomeric compounds. In the present invention, the mechanism of pairing involves hydrogen bonding, which may be Watson-Crick, Hoogsteen or reversed Hoogsteen hydrogen bonding, between complementary nucleoside or nucleotide bases (nucleobases) of the strands of oligomeric compounds. For example, adenine and thymine are complementary nucleobases that pair through the formation of hydrogen bonds. Hybridization can occur under varying circumstances.

An oligomeric compound of the invention is "specifically hybridizable" when association of the compound with the target nucleic acid interferes with the normal function of the target nucleic acid to alter the activity, disrupt the function, or modulate the level of the target nucleic acid, and there is a sufficient degree of complementarity to avoid non-specific binding of the oligomeric compound to non-target nucleic acid sequences under conditions in which specific hybridization is desired, i.e., under physiological conditions in the case of in vivo assays or therapeutic treatment, and under standard assay conditions in the case of in vitro assays.

In the present invention the phrase "stringent hybridization conditions" or "stringent conditions" refers to conditions under which an oligomeric compound of the invention will hybridize to its target sequence, but to a minimal number of other sequences. Stringent conditions are sequence-dependent and will vary with different circumstances and in the context of this invention; "stringent conditions" under which oligomeric compounds hybridize to a target sequence are determined by the nature and composition of the oligomeric compounds and the assays in which they are being investigated. One having ordinary skill in the art will understand variability in the experimental protocols and be able to determine when conditions are optimal for stringent hybridization with minimal non-specific hybridization events.

"Complementary," as used herein, refers to the capacity for precise pairing of two monomeric subunits regardless of where in the oligomeric compound or target nucleic acid the two are located. For example, if a monomeric subunit at a certain position of an oligomeric compound is capable of hydrogen bonding with a monomeric subunit at a certain position of a target nucleic acid, then the position of hydrogen bonding between the oligomeric compound and the target nucleic acid is considered to be a complementary position. The oligomeric compound and the target nucleic acid are "substantially complementary" to each other when a sufficient number of complementary positions in each molecule are occupied by monomeric subunits that can hydrogen bond with each other. Thus, the term "substantially complementary" is used to indicate a sufficient degree of precise pairing over a sufficient number of monomeric subunits such that stable and specific binding occurs between the oligomeric compound and a target nucleic acid.

Generally, an oligomeric compound is "antisense" to a target nucleic acid when, written in the 5' to 3' direction, it comprises the reverse complement of the corresponding region of the target nucleic acid. "Antisense compounds" are also often defined in the art to comprise the further limitation of, once hybridized to a target, being able to induce or trigger a reduction in target gene expression.

It is understood in the art that the sequence of the oligomeric compound need not be 100% complementary to that of its target nucleic acid to be specifically hybridizable. Moreover, an oligomeric compound may hybridize over one or more segments such that intervening or adjacent segments are not involved in the hybridization (e.g., a bulge, a loop structure or a hairpin structure).

In some embodiments of the invention, the oligomeric compounds comprise at least 50%, at least 60%, at least 70%, at least 75%, at least 80%, or at least 85% sequence complementarity to a target region within the target nucleic acid. In other embodiments of the invention, the oligomeric compounds comprise at least 90% sequence complementarity to a target region within the target nucleic acid. In other embodiments of the invention, the oligomeric compounds comprise at least 95% or at least 99% sequence complementarity to a target region within the target nucleic acid. For example, an oligomeric compound in which 18 of 20 nucleobases of the oligomeric compound are complementary to a target sequence would represent 90 percent complementarity. In this example, the remaining noncomplementary nucleobases may be clustered or interspersed with complementary nucleobases and need not be contiguous to each other or to complementary nucleobases. As such, an oligomeric compound which is 18 nucleobases in length having 4 (four) noncomplementary nucleobases which are flanked by two regions of complete complementarity with the target nucleic acid would have 77.8% overall complementarity with the target nucleic acid and would thus fall within the scope of the present invention. Percent complementarity of an oligomeric compound with a region of a target nucleic acid can be determined routinely using BLAST programs (basic local alignment search tools) and PowerBLAST programs known in the art (Altschul et al., J. Mol. Biol., 1990, 215, 403-410; Zhang and Madden, Genome Res., 1997, 7, 649-656).

In some embodiments of the invention, the oligomeric compounds act as mimics or replacements for small non-coding RNAs. In this case, the oligomeric compounds of the invention can comprise at least 70% sequence identity to a small non-coding RNA or a region thereof. In some embodiments the oligomeric compounds of the invention can comprise at least 90% sequence identity and in some embodiments can comprise at least 95% sequence identity to a small non-coding RNA or a region thereof.

"Targeting" an oligomeric compound to a particular nucleic acid molecule, in the context of this invention, can be a multistep process. The process usually begins with the identification of a target nucleic acid whose levels, expression or function is to be modulated. This target nucleic acid may be, for example, a mRNA transcribed from a cellular gene whose expression is associated with a particular disorder or disease state, a small non-coding RNA or its precursor, or a nucleic acid molecule from an infectious agent.

The targeting process usually also includes determination of at least one target region, segment, or site within the target nucleic acid for the interaction to occur such that the desired effect, e.g., modulation of levels, expression or function, will result. Within the context of the present invention, the term "region" is defined as a portion of the target nucleic acid having at least one identifiable sequence, structure, function, or characteristic. Within regions of target nucleic acids are segments. "Segments" are defined as smaller or sub-portions of regions within a target nucleic acid. "Sites," as used in the present invention, are defined as specific positions within a target nucleic acid. The terms region, segment, and site can also be used to describe an oligomeric compound of the invention such as for example a gapped oligomeric compound having three separate segments.

Targets of the present invention include both coding and non-coding nucleic acid sequences. For coding nucleic acid sequences, the translation initiation codon is typically 5'-AUG (in transcribed mRNA molecules; 5'-ATG in the corresponding DNA molecule), the translation initiation codon is also referred to as the "AUG codon," the "start codon" or the "AUG start codon." A minority of genes have a translation initiation codon having the RNA sequence 5'-GUG, 5'-UUG or 5'-CUG, and 5'-AUA, 5'-ACG and 5'-CUG have been shown to function in vivo. Thus, the terms "translation initiation codon" and "start codon" can encompass many codon sequences, even though the initiator amino acid in each instance is typically methionine (in eukaryotes) or formylmethionine (in prokaryotes). It is also known in the art that eukaryotic and prokaryotic genes may have two or more alternative start codons, any one of which may be preferentially utilized for translation initiation in a particular cell type or tissue, or under a particular set of conditions. In the context of the invention, "start codon" and "translation initiation codon" refer to the codon or codons that are used in vivo to initiate translation of an mRNA transcribed from a gene encoding a nucleic acid target, regardless of the sequence(s) of such codons. It is also known in the art that a translation termination codon (or "stop codon") of a gene may have one of three sequences, i.e., 5'-UAA, 5'-UAG and 5'-UGA (the corresponding DNA sequences are 5'-TAA, 5'-TAG and 5'-TGA, respectively).

The terms "start codon region" and "translation initiation codon region" refer to a portion of such an mRNA or gene that encompasses from about 25 to about 50 contiguous nucleotides in either direction (i.e., 5' or 3') from a translation initiation codon. Similarly, the terms "stop codon region" and "translation termination codon region" refer to a portion of such an mRNA or gene that encompasses from about 25 to about 50 contiguous nucleotides in either direction (i.e., 5' or 3') from a translation termination codon. Consequently, the "start codon region" (or "translation initiation codon region") and the "stop codon region" (or "translation termination codon region") are all regions which may be targeted effectively with the oligomeric compounds of the present invention.

The open reading frame (ORF) or "coding region," which is known in the art to refer to the region between the translation initiation codon and the translation termination codon, is also a region which may be targeted effectively. Within the context of the present invention, a further suitable region is the intragenic region encompassing the translation initiation or termination codon of the open reading frame (ORF) of a gene.

Other target regions include the 5' untranslated region (5'UTR), known in the art to refer to the portion of an mRNA in the 5' direction from the translation initiation codon, and thus including nucleotides between the 5' cap site and the translation initiation codon of an mRNA (or corresponding nucleotides on the gene), and the 3' untranslated region (3'UTR), known in the art to refer to the portion of an mRNA in the 3' direction from the translation termination codon, and thus including nucleotides between the translation termination codon and 3' end of an mRNA (or corresponding nucleotides on the gene). The 5' cap site of an mRNA comprises an N7-methylated guanosine residue joined to the 5'-most residue of the mRNA via a 5'-5' triphosphate linkage. The 5' cap region of an mRNA is considered to include the 5' cap structure itself as well as the first 50 nucleotides adjacent to the cap site. It is also suitable to target the 5' cap region.

Although some eukaryotic mRNA transcripts are directly translated, many contain one or more regions, known as "introns," which are excised from a transcript before it is translated. The remaining (and therefore translated) regions are known as "exons" and are spliced together to form a continuous mRNA sequence. Targeting splice sites, i.e., intron-exon junctions or exon-intron junctions, may also be particularly useful in situations where aberrant splicing is implicated in disease, or where an overproduction of a particular splice product is implicated in disease. Aberrant fusion junctions due to rearrangements or deletions are also target sites. mRNA transcripts produced via the process of splicing of two (or more) mRNAs from different gene sources are known as "fusion transcripts." It is also known that introns can be effectively targeted using oligomeric compounds targeted to, precursor molecules for example, pre-mRNA.

It is also known in the art that alternative RNA transcripts can be produced from the same genomic region of DNA. These alternative transcripts are generally known as "variants." More specifically, "pre-mRNA variants" are transcripts produced from the same genomic DNA that differ from other transcripts produced from the same genomic DNA in either their start or stop position and contain both intronic and exonic sequences.

Upon excision of one or more exon or intron regions, or portions thereof, during splicing, pre-mRNA variants produce smaller "mRNA variants." Consequently, mRNA variants are processed pre-mRNA variants and each unique pre-mRNA variant must always produce a unique mRNA variant as a result of splicing. These mRNA variants are also known as "alternative splice variants." If no splicing of the pre-mRNA variant occurs then the pre-mRNA variant is identical to the mRNA variant.

It is also known in the art that variants can be produced through the use of alternative signals to start or stop transcription and that pre-mRNAs and mRNAs can possess more that one start codon or stop codon. Variants that originate from a pre-mRNA or mRNA that use alternative start codons are known as "alternative start variants" of that pre-mRNA or mRNA. Those transcripts that use an alternative stop codon are known as "alternative stop variants" of that pre-mRNA or mRNA. One specific type of alternative stop variant is the "polyA variant" in which the multiple transcripts produced result from the alternative selection of one of the "polyA stop signals" by the transcription machinery, thereby producing transcripts that terminate at unique polyA sites. Within the context of the invention, the types of variants described herein are also target nucleic acids.

Certain non-coding RNA genes are known to produce functional RNA molecules with important roles in diverse cellular processes. Such non-translated, non-coding RNA molecules can include ribosomal RNAs, tRNAs, snRNAs, snoRNAs, tncRNAs, rasiRNAs, short hairpin RNAs (shRNAs), short temporal RNAs (stRNAs), short hairpin RNAs (shRNAs), siRNAs, miRNAs and smnRNAs. These non-coding RNA genes and their products are also suitable targets of the compounds of the invention. Such cellular processes include transcriptional regulation, translational regulation, developmental timing, viral surveillance, immunity, chromosome maintenance, ribosomal structure and function, gene imprinting, subcellular compartmentalization, pre-mRNA splicing, and guidance of RNA modifications. RNA-mediated processes are now also believed to direct heterochromatin formation, genome rearrangements, cellular differentiation and DNA elimination.

A total of 201 different expressed RNA sequences potentially encoding novel small non-messenger species (smnRNAs) has been identified from mouse brain cDNA libraries. Based on sequence and structural motifs, several of these have been assigned to the snoRNA class of nucleolar localized molecules known to act as guide RNAs for rRNA modification, whereas others are predicted to direct modification within the U2, U4, or U6 small nuclear RNAs (snRNAs). Some of these newly identified smnRNAs remained unclassified and have no identified RNA targets. It was suggested that some of these RNA species may have novel functions previously unknown for snoRNAs, namely the regulation of gene expression by binding to and/or modifying mRNAs or their precursors via their antisense elements (Huttenhofer et al., Embo J., 2001, 20, 2943-2953). Therefore, these smnRNAs are also suitable targets for the compounds of the present invention.

The locations on the target nucleic acid to which compounds and compositions of the invention hybridize are herein referred to as "suitable target segments." As used herein the term "suitable target segment" is defined as at least an 8-nucleobase portion of a target region to which oligomeric compound is targeted.

Once one or more targets, target regions, segments or sites have been identified, oligomeric compounds are designed to be sufficiently complementary to the target, i.e., hybridize sufficiently well and with sufficient specificity, to give the desired effect. The desired effect may include, but is not limited to modulation of the levels, expression or function of the target.

In accordance with the present invention, a series of single stranded oligomeric compounds can be designed to target or mimic one or more specific small non-coding RNAs. These oligomeric compounds can be of a specified length, for example from 8 to 80, 12 to 50, 13 to 80, 15 to 30, 70 to 450, 110 to 430, 110 to 280, 50 to 110, 60 to 80, 15to 49, 17 to 25 or 19 to 23 nucleotides long and have one or more modifications.

In accordance with one embodiment of the invention, a series of double-stranded oligomeric compounds (duplexes) comprising, as the antisense strand, the single-stranded oligomeric compounds of the present invention, and the fully or partially complementary sense strand, can be designed to modulate the levels, expression or function of one or more small non-coding RNAs or small non-coding RNA targets. One or both termini of the duplex strands may be modified by the addition of one or more natural or modified nucleobases to form an overhang. The sense strand of the duplex may be designed and synthesized as the complement of the antisense strand and may also contain modifications or additions to either terminus. For example, in one embodiment, both strands of the duplex would be complementary over the central region of the duplex, each having overhangs at one or both termini.

For the purposes of this invention, the combination of an antisense strand and a sense strand, each of which can be of a specified length, for example from 8 to 80, 12 to 50, 13 to 80, 15 to 30, 15 to 49, 17 to 25 or 19 to 23 subunits long, is identified as a complementary pair of oligomeric compounds. This complementary pair of oligonucleotides can include additional nucleotides on either of their 5' or 3' ends. They can include other molecules or molecular structures on their 3' or 5' ends, such as a phosphate group on the 5' end, or non-nucleic acid moieties conjugated to either terminus of either strand or both strands. One group of compounds of the invention includes a phosphate group on the 5' end of the antisense strand compound. Other compounds also include a phosphate group on the 5' end of the sense strand compound. Some compounds include additional nucleotides such as a two base overhang on the 3' end as well as those lacking overhangs.

For example, a complementary pair of oligomeric compounds may comprise an antisense strand oligomeric compound having the sequence CGAGAGGCGGACGGGACCG (SEQ ID NO:2181), having a two-nucleobase overhang of deoxythymidine (dT) and its complement sense strand. This complementary pair of oligomeric compounds would have the following structure:

pound, when folded back on itself, would form at least a partially complementary structure at least between a portion of the first region, the antisense portion, and a portion of the second region, the sense portion.

In one embodiment, the invention includes an oligomeric compound/protein composition. This composition has both an oligomeric compound component and a protein component. The oligomeric compound component comprises at least one oligomeric compound, either the antisense or the sense oligomeric compound but preferably the antisense oligomeric compound (the oligomeric compound that is antisense to the target nucleic acid). The protein component of the composition comprises at least one protein that forms a portion of the RNA-induced silencing complex, i.e., the RISC complex. The oligomeric compound component can also comprise both antisense and sense strand oligomeric compounds.

RISC is a ribonucleoprotein complex that contains proteins of the Argonaute family of proteins. While not wishing to be bound by theory, it is believed that the Argonaute proteins are a class of proteins, some of which have been shown to contain a PAZ and/or a Piwi domain and that have been implicated in processes previously linked to posttranscriptional silencing. The Argonaute family of proteins includes, but depending on species, is not necessary limited to e1F2C1 and e1F2C2. It is also believed that at least the antisense strand of double-stranded compounds shown to act as siRNAs is bound to one of the protein components that form the RISC complex, and that the RISC complex interacts with the ribosomes or polyribosome complexes which may contain small non-coding RNA molecules amenable to targeting with the oligomeric compounds of the present invention. Consequently, one embodiment of the invention includes oligomeric compounds that mimic RNA components of the RISC complex.

In one embodiment, the oligomeric compounds of the invention are designed to exert their modulatory effects via mimicking or targeting small non-coding RNAs associated with cellular factors such as transporters or chaperones. These cellular factors can be protein, lipid or carbohydrate based and can have structural or enzymatic functions that may or may not require the complexation of one or more metal ions.

Furthermore, the oligomeric compounds of the invention can have one or more moieties bound or conjugated, which facilitates the active or passive transport, localization, or compartmentalization of the oligomeric compound. Cellular localization includes, but is not limited to, localization to within the nucleus, the nucleolus, or the cytoplasm. Compartmentalization includes, but is not limited to, any directed movement of the oligonucleotides of the invention to a cellular compartment including the nucleus, nucleolus, mitochondrion, or imbedding into a cellular membrane.

```
cgagaggcggacgggaccgTT   Antisense Strand (SEQ ID NO:2182)
||||||||||||||||||||
TTgctctccgcctgccctggc   Complement Sense Strand (SEQ ID NO:2183)
```

In some embodiments, a single-stranded oligomeric compound may be designed comprising the antisense portion as a first region and the sense portion as a second region. The first and second regions can be linked together by either a nucleotide linker (a string of one or more nucleotides that are linked together in a sequence) or by a non-nucleotide linker region or by a combination of both a nucleotide and non-nucleotide structure. In any of these structures, the oligomeric com- In some embodiments of the invention, the oligomeric compounds are designed to exert their modulatory effects via mimicking or targeting small non-coding RNAs associated with cellular factors that affect gene expression, more specifically those involved in RNA or DNA modifications. These modifications include, but are not limited to, posttranscriptional or chromosomal modifications such as methylation, acetylation, pseudouridylation or amination.

Furthermore, the oligomeric compounds of the invention comprise one or more conjugate moieties which facilitate posttranscriptional modification.

The oligomeric compounds of the invention may be in the form of single-stranded, double-stranded, circular or hairpin oligomeric compounds and may contain structural elements such as internal or terminal bulges or loops. Once introduced to a system, the oligomeric compounds of the invention may elicit the action of one or more enzymes or proteins to effect modulation of the levels, expression or function of the target nucleic acid.

One non-limiting example of such a protein is the Drosha RNase III enzyme. Drosha is a nuclear enzyme that processes long primary RNA transcripts (pri-miRNAs) from approximately 70 to 450 nucleotides in length into pre-miRNAs (from about 50 to about 80 nucleotides in length) which are exported from the nucleus to encounter the human Dicer enzyme which then processes pre-miRNAs into miRNAs. It is believed that, in processing the pri-miRNA into the pre-miRNA, the Drosha enzyme cuts the pri-miRNA at the base of the mature miRNA, leaving a 2-nt 3'overhang (Lee, et al., Nature, 2003, 425, 415-419). The 3' two-nucleotide overhang structure, a signature of RNaseIII enzymatic cleavage, has been identified as a critical specificity determinant in targeting and maintaining small RNAs in the RNA interference pathway (Murchison, et al., Curr. Opin. Cell Biol., 2004, 16, 223-9).

A further non-limiting example involves the enzymes of the RISC complex. Use of the RISC complex to effect cleavage of RNA targets thereby greatly enhances the efficiency of oligonucleotide-mediated inhibition of gene expression. Similar roles have been postulated for other ribonucleases such as those in the RNase III and ribonuclease L family of enzymes.

Oligomeric compounds or compositions of the invention are used to induce potent and specific modulation of gene function through interactions with or mimicry of small non-coding RNAs that are processed by the RISC complex. These compounds include single-stranded oligomeric compounds that bind in a RISC complex, double-stranded anti sense/sense pairs of oligomeric compounds, or single-stranded oligomeric compounds that include both an anti sense portion and a sense portion.

General Oligomer Synthesis:

Oligomerization of modified and unmodified nucleosides is performed according to literature procedures for DNA like compounds (Protocols for Oligonucleotides and Analogs, Ed. Agrawal (1993), Humana Press) and/or RNA like compounds (Scaringe, Methods (2001), 23, 206-217. Gait et al., Applications of Chemically synthesized RNA in RNA:Protein Interactions, Ed. Smith (1998), 1-36. Gallo et al., Tetrahedron (2001), 57, 5707-5713) synthesis as appropriate. In addition, specific protocols for the synthesis of oligomeric compounds of the invention are illustrated in the examples below.

RNA oligomers can be synthesized by methods disclosed herein or purchased from various RNA synthesis companies such as for example Dharmacon Research Inc., (Lafayette, Colo.).

Irrespective of the particular protocol used, the oligomeric compounds used in accordance with this invention may be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed.

Synthesis of Nucleoside Phosphoramidites:

The following compounds, including amidites and their intermediates were prepared as described in U.S. Pat. No. 6,426,220 and published PCT WO 02/36743; 5'-O-Dimethoxytrityl-thymidine intermediate for 5-methyl dC amidite, 5'-O-Dimethoxytrityl-2'-deoxy-5-methylcytidine intermediate for 5-methyl-dC amidite, 5'-O-Dimethoxytrityl-2'-deoxy-N4-benzoyl-5-methylcytidine penultimate intermediate for 5-methyl dC amidite, (5'-O-(4,4'-Dimethoxytriphenylmethyl)-2'-deoxy-N$^4$-benzoyl-5-methylcytidin-3'-O-yl)-2-cyanoethyl-N,N-diisopropylphosphoramidite (5-methyl dC amidite), 2'-Fluorodeoxyadenosine, 2'-Fluorodeoxyguanosine, 2'-Fluorouridine, 2'-Fluorodeoxycytidine, 2'-O-(2-Methoxyethyl) modified amidites, 2'-O-(2-methoxyethyl)-5-methyluridine intermediate, 5'-O-DMT-2'-O-(2-methoxyethyl)-5-methyluridine penultimate intermediate, (5'-O-(4,4'-Dimethoxytriphenylmethyl)-2'-O-(2-methoxyethyl)-5-methyluridin-3'-O-yl)-2-cyanoethyl-N,N-diisopropylphosphoramidite (MOE T amidite), 5'-O-Dimethoxytrityl-2'-O-(2-methoxyethyl)-5-methylcytidine intermediate, 5'-O-dimethoxytrityl-2'-O-(2-methoxyethyl)-N$^4$-benzoyl-5-methyl-cytidine penultimate intermediate, (5'-O-(4,4'-Dimethoxytriphenylmethyl)-2'-O-(2-methoxyethyl)-N$^4$-benzoyl-5-methylcytidin-3'-O-yl)-2-cyanoethyl-N,N-diisopropylphosphoramidite (MOE 5-Me-C amidite), (5'-O-(4,4'-Dimethoxytriphenylmethyl)-2'-O-(2-methoxyethyl)-N$^6$-benzoyladenosin-3'-O-yl)-2-cyanoethyl-N,N-diisopropylphosphoramidite (MOE A amdite), (5'-O-(4,4'-Dimethoxytriphenylmethyl)-2'-O-(2-methoxyethyl)-N$^4$-isobutyrylguanosin-3'-O-yl)-2-cyanoethyl-N,N-diisopropylphosphoramidite (MOE G amidite), 2'-O-(Aminooxyethyl)nucleoside amidites and 2'-O-(dimethylaminooxyethyl)nucleoside amidites, 2'-(Dimethylaminooxyethoxy)nucleoside amidites, 5'-O-tert-Butyldiphenylsilyl-O$^2$-2'-anhydro-5-methyluridine, 5'-O-tert-Butyldiphenylsilyl-2'-O-(2-hydroxyethyl)-5-methyluridine, 2'-O-((2-phthalimidoxy)ethyl)-5'-t-butyldiphenylsilyl-5-methyluridine, 5'-O-tert-butyldiphenylsilyl-2'-O-((2-formadoximinooxy)ethyl)-5-methyluridine, 5'-O-tert-Butyldiphenylsilyl-2'-O-(N,N dimethylaminooxyethyl)-5-methyluridine, 2'-O-(dimethylaminooxyethyl)-5-methyluridine, 5'-O-DMT-2'-O-(dimethylaminooxyethyl)-5-methyluridine, 5'-O-DMT-2'-O-(2-N,N-dimethylaminooxyethyl)-5-methyluridine-3'-((2-cyanoethyl)-N,N-diisopropylphosphoramidite), 2'-(Aminooxyethoxy)nucleoside amidites, N2-isobutyryl-6-O-diphenylcarbamoyl-2'-O-(2-ethylacetyl)-5'-O-(4,4'-dimethoxytrityl)guanosine-3'-((2-cyanoethyl)-N,N-diisopropylphosphoramidite), 2'-dimethylaminoethoxyethoxy(2'-DMAEOE)nucleoside amidites, 2'-O-(2(2-N,N-dimethylaminoethoxy)ethyl)-5-methyl uridine, 5'-O-dimethoxytrityl-2'-O-(2(2-N,N-dimethylaminoethoxy)-ethyl))-5-methyl uridine and 5'-O-Dimethoxytrityl-2'-O-(2(2-N,N-dimethylaminoethoxy)-ethyl))-5-methyl uridine-3'-O-(cyanoethyl-N,N-diisopropyl) phosphoramidite.

Oligonucleotide and Oligonucleoside Synthesis:

Oligonucleotides: Unsubstituted and substituted phosphodiester (P=O) oligonucleotides are synthesized on an automated DNA synthesizer (Applied Biosystems model 394) using standard phosphoramidite chemistry with oxidation by iodine.

Phosphorothioates (P=S) are synthesized similar to phosphodiester oligonucleotides with the following exceptions: thiation was effected by utilizing a 10% w/v solution of 3,H-1,2-benzodithiole-3-one 1,1-dioxide in acetonitrile for the oxidation of the phosphite linkages. The thiation reaction step time was increased to 180 sec and preceded by the normal capping step. After cleavage from the CPG column and deblocking in concentrated ammonium hydroxide at 55° C. (12-16 hr), the oligonucleotides were recovered by precipitating with >3 volumes of ethanol from a 1 M $NH_4OAc$ solution. Phosphinate oligonucleotides are prepared as described in U.S. Pat. No. 5,508,270, herein incorporated by reference.

Alkyl phosphonate oligonucleotides are prepared as described in U.S. Pat. No. 4,469,863, herein incorporated by reference.

3'-Deoxy-3'-methylene phosphonate oligonucleotides are prepared as described in U.S. Pat. Nos. 5,610,289 or 5,625,050, herein incorporated by reference.

Phosphoramidite oligonucleotides are prepared as described in U.S. Pat. No. 5,256,775 or U.S. Pat. No. 5,366,878, herein incorporated by reference.

Alkylphosphonothioate oligonucleotides are prepared as described in published PCT applications PCT/US94/00902 and PCT/US93/06976 (published as WO 94/17093 and WO 94/02499, respectively), herein incorporated by reference.

3'-Deoxy-3'-amino phosphoramidate oligonucleotides are prepared as described in U.S. Pat. No. 5,476,925, herein incorporated by reference.

Phosphotriester oligonucleotides are prepared as described in U.S. Pat. No. 5,023,243, herein incorporated by reference.

Borano phosphate oligonucleotides are prepared as described in U.S. Pat. Nos. 5,130,302 and 5,177,198, both herein incorporated by reference.

Oligonucleosides: Methylenemethylimino linked oligonucleosides, also identified as MMI linked oligonucleosides, methylenedimethylhydrazo linked oligonucleosides, also identified as MDH linked oligonucleosides, and methylenecarbonylamino linked oligonucleosides, also identified as amide-3 linked oligonucleosides, and methyleneaminocarbonyl linked oligonucleosides, also identified as amide-4 linked oligonucleosides, as well as mixed backbone oligomeric compounds having, for instance, alternating MMI and P=O or P=S linkages are prepared as described in U.S. Pat. Nos. 5,378,825, 5,386,023, 5,489,677, 5,602,240 and 5,610,289, all of which are herein incorporated by reference.

Formacetal and thioformacetal linked oligonucleosides are prepared as described in U.S. Pat. Nos. 5,264,562 and 5,264,564, herein incorporated by reference.

Ethylene oxide linked oligonucleosides are prepared as described in U.S. Pat. No. 5,223,618, herein incorporated by reference.

RNA Synthesis:

In general, RNA synthesis chemistry is based on the selective incorporation of various protecting groups at strategic intermediary reactions. Although one of ordinary skill in the art will understand the use of protecting groups in organic synthesis, a useful class of protecting groups includes silyl ethers. In particular bulky silyl ethers are used to protect the 5'-hydroxyl in combination with an acid-labile orthoester protecting group on the 2'-hydroxyl. This set of protecting groups is then used with standard solid-phase synthesis technology. It is important to lastly remove the acid labile orthoester protecting group after all other synthetic steps. Moreover, the early use of the silyl protecting groups during synthesis ensures facile removal when desired, without undesired deprotection of 2' hydroxyl.

Following this procedure for the sequential protection of the 5'-hydroxyl in combination with protection of the 2'-hydroxyl by protecting groups that are differentially removed and are differentially chemically labile, RNA oligonucleotides were synthesized.

RNA oligonucleotides are synthesized in a stepwise fashion. Each nucleotide is added sequentially (3'- to 5'-direction) to a solid support-bound oligonucleotide. The first nucleoside at the 3'-end of the chain is covalently attached to a solid support. The nucleotide precursor, a ribonucleoside phosphoramidite, and activator are added, coupling the second base onto the 5'-end of the first nucleoside. The support is washed and any unreacted 5'-hydroxyl groups are capped with acetic anhydride to yield 5'-acetyl moieties. The linkage is then oxidized to the more stable and ultimately desired P(V) linkage. At the end of the nucleotide addition cycle, the 5'-silyl group is cleaved with fluoride. The cycle is repeated for each subsequent nucleotide.

Following synthesis, the methyl protecting groups on the phosphates are cleaved in 30 minutes utilizing 1 M disodium-2-carbamoyl-2-cyanoethylene-1,1-dithiolate trihydrate ($S_2Na_2$) in DMF. The deprotection solution is washed from the solid support-bound oligonucleotide using water. The support is then treated with 40% methylamine in water for 10 minutes at 55° C. This releases the RNA oligonucleotides into solution, deprotects the exocyclic amines, and modifies the 2'- groups. The oligonucleotides can be analyzed by anion exchange HPLC at this stage.

The 2'-orthoester groups are the last protecting groups to be removed. The ethylene glycol monoacetate orthoester protecting group developed by Dharmacon Research, Inc. (Lafayette, Colo.), is one example of a useful orthoester protecting group which, has the following important properties. It is stable to the conditions of nucleoside phosphoramidite synthesis and oligonucleotide synthesis. However, after oligonucleotide synthesis the oligonucleotide is treated with methylamine which not only cleaves the oligonucleotide from the solid support but also removes the acetyl groups from the orthoesters. The resulting 2-ethyl-hydroxyl substituents on the orthoester are less electron withdrawing than the acetylated precursor. As a result, the modified orthoester becomes more labile to acid-catalyzed hydrolysis. Specifically, the rate of cleavage is approximately 10 times faster after the acetyl groups are removed. Therefore, this orthoester possesses sufficient stability in order to be compatible with oligonucleotide synthesis and yet, when subsequently modified, permits deprotection to be carried out under relatively mild aqueous conditions compatible with the final RNA oligonucleotide product.

Additionally, methods of RNA synthesis are well known in the art (Scaringe, S. A. Ph.D. Thesis, University of Colorado, 1996; Scaringe, S. A., et al., *J. Am. Chem. Soc.*, 1998, 120, 11820-11821; Matteucci, M. D. and Caruthers, M. H. *J. Am. Chem. Soc.*, 1981, 103, 3185-3191; Beaucage, S. L. and Caruthers, M. H. *Tetrahedron Lett.*, 1981, 22, 1859-1862; Dahl, B. J., et al., *Acta Chem. Scand,.* 1990, 44, 639-641; Reddy, M. P., et al., *Tetrahedrom Lett.*, 1994, 25, 4311-4314; Wincott, F. et al., *Nucleic Acids Res.*, 1995, 23, 2677-2684; Griffin, B. E., et al., *Tetrahedron*, 1967, 23, 2301-2313; Griffin, B. E., et al., *Tetrahedron*, 1967, 23, 2315-2331).

The present invention is also useful for the preparation of oligomeric compounds incorporating at least one 2'-O-protected nucleoside. After incorporation and appropriate deprotection the 2'-O-protected nucleoside will be converted to a ribonucleoside at the position of incorporation. The number and position of the 2-ribonucleoside units in the final oligomeric compound can vary from one at any site or the strategy can be used to prepare up to a full 2'-OH modified oligomeric compound. All 2'-O-protecting groups amenable to the synthesis of oligomeric compounds are included in the present invention.

In general a protected nucleoside is attached to a solid support by for example a succinate linker. Then the oligonucleotide is elongated by repeated cycles of deprotecting the 5'-terminal hydroxyl group, coupling of a further nucleoside unit, capping and oxidation (alternatively sulfurization). In a more frequently used method of synthesis the completed oligonucleotide is cleaved from the solid support with the removal of phosphate protecting groups and exocyclic amino protecting groups by treatment with an ammonia solution. Then a further deprotection step is normally required for the more specialized protecting groups used for the protection of 2'-hydroxyl groups which will give the fully deprotected oligonucleotide.

A large number of 2'-O-protecting groups have been used for the synthesis of oligoribonucleotides but over the years more effective groups have been discovered. The key to an effective 2'-O-protecting group is that it is capable of selectively being introduced at the 2'-O-position and that it can be removed easily after synthesis without the formation of unwanted side products. The protecting group also needs to be inert to the normal deprotecting, coupling, and capping steps required for oligoribonucleotide synthesis. Some of the protecting groups used initially for oligoribonucleotide synthesis included tetrahydropyran-1-yl and 4-methoxytetrahydropyran-4-yl. These two groups are not compatible with all 5'-O-protecting groups so modified versions were used with 5'-DMT groups such as 1-(2-fluorophenyl)-4-methoxypiperidin-4-yl (Fpmp). Reese has identified a number of piperidine derivatives (like Fpmp) that are useful in the synthesis of oligoribonucleotides including 1-((chloro-4-methyl)phenyl)-4'-methoxypiperidin-4-yl (Reese et al., *Tetrahedron Lett.*, 1986, (27), 2291). Another approach was to replace the standard 5'-DMT (dimethoxytrityl) group with protecting groups that were removed under non-acidic conditions such as levulinyl and 9-fluorenylmethoxycarbonyl. Such groups enable the use of acid labile 2'-protecting groups for oligoribonucleotide synthesis. Another more widely used protecting group initially used for the synthesis of oligoribonucleotides was the t-butyldimethylsilyl group (Ogilvie et al., *Tetrahedron Lett.*, 1974, 2861; Hakimelahi et al., *Tetrahedron Lett.*, 1981, (22), 2543; and Jones et al., *J. Chem. Soc. Perkin I.*, 2762). The 2'-O-protectin groups can require special reagents for their removal such as for example the t-butyldimethylsilyl group is normally removed after all other cleaving/deprotecting steps by treatment of the oligomeric compound with tetrabutylammonium fluoride (TBAF).

One group of researchers examined a number of 2'-O-protecting groups (Pitsch, S., *Chimia*, 2001, (55), 320-324.) The group examined fluoride labile and photolabile protecting groups that are removed using moderate conditions. One photolabile group that was examined was the (2-(nitrobenzyl)oxy)methyl (nbm) protecting group (Schwartz et al., *Bioorg. Med. Chem. Lett.*, 1992, (2), 1019.) Other groups examined included a number structurally related formaldehyde acetal-derived, 2'-O-protecting groups. Also prepared were a number of related protecting groups for preparing 2'-O-alkylated nucleoside phosphoramidites including 2'-O-((triisopropylsilyl)oxy)methyl(2'-O—CH$_2$—O—Si(iPr)$_3$, TOM). One 2'-O-protecting group that was prepared to be used orthogonally to the TOM group was 2'-O-((R)-1-(2-nitrophenyl)ethyloxy)methyl) ((R)-mnbm).

Another strategy using a fluoride labile 5'-O-protecting group (non-acid labile) and an acid labile 2'-O-protecting group has been reported (Scaringe, Stephen A., *Methods*, 2001, (23) 206-217). A number of possible silyl ethers were examined for 5'-O-protection and a number of acetals and orthoesters were examined for 2'-O-protection. The protection scheme that gave the best results was 5'-O-silyl ether-2'-ACE (5'-O-bis(trimethylsiloxy)cyclododecyloxysilyl ether (DOD)-2'-O-bis(2-acetoxyethoxy)methyl (ACE). This approach uses a modified phosphoramidite synthesis approach in that some different reagents are required that are not routinely used for RNA/DNA synthesis.

Although a lot of research has focused on the synthesis of oligoribonucleotides the main RNA synthesis strategies that are presently being used commercially include 5'-O-DMT-2'-O-t-butyldimethylsilyl (TBDMS), 5'-O-DMT-2'-O-(1(2-fluorophenyl)-4-methoxypiperidin-4-yl) (FPMP), 2'-O-((triisopropylsilyl)oxy)methyl(2'-O—CH$_2$—O—Si(iPr)$_3$ (TOM), and the 5'-O-silyl ether-2'-ACE (5'-O-bis(trimethylsiloxy)cyclododecyloxysilyl ether (DOD)-2'-O-bis(2-acetoxyethoxy)methyl (ACE). A current list of some of the major companies currently offering RNA products include Pierce Nucleic Acid Technologies, Dharmacon Research Inc., Ameri Biotechnologies Inc., and Integrated DNA Technologies, Inc. One company, Princeton Separations, is marketing an RNA synthesis activator advertised to reduce coupling times especially with TOM and TBDMS chemistries. Such an activator would also be amenable to the present invention.

The structures corresponding to these protecting groups are shown below.

TBDMS=5'-O-DMT-2'-O-t-butyldimethylsilyl;

TOM=2'-O-((triisopropylsilyl)oxy)methyl;

DOD/ACE=(5'-O-bis(trimethylsiloxy)cyclododecyloxysilyl ether-2'-O-bis(2-acetoxyethoxy)methyl FPMP=5'-O-DMT-2'-O-(1(2-fluorophenyl)-4-methoxypiperidin-4-yl)

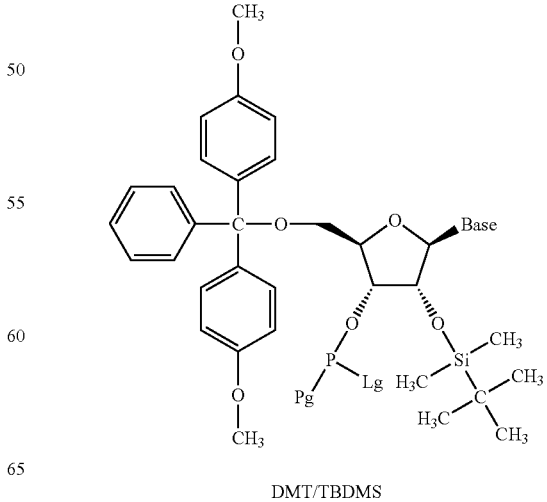

DMT/TBDMS

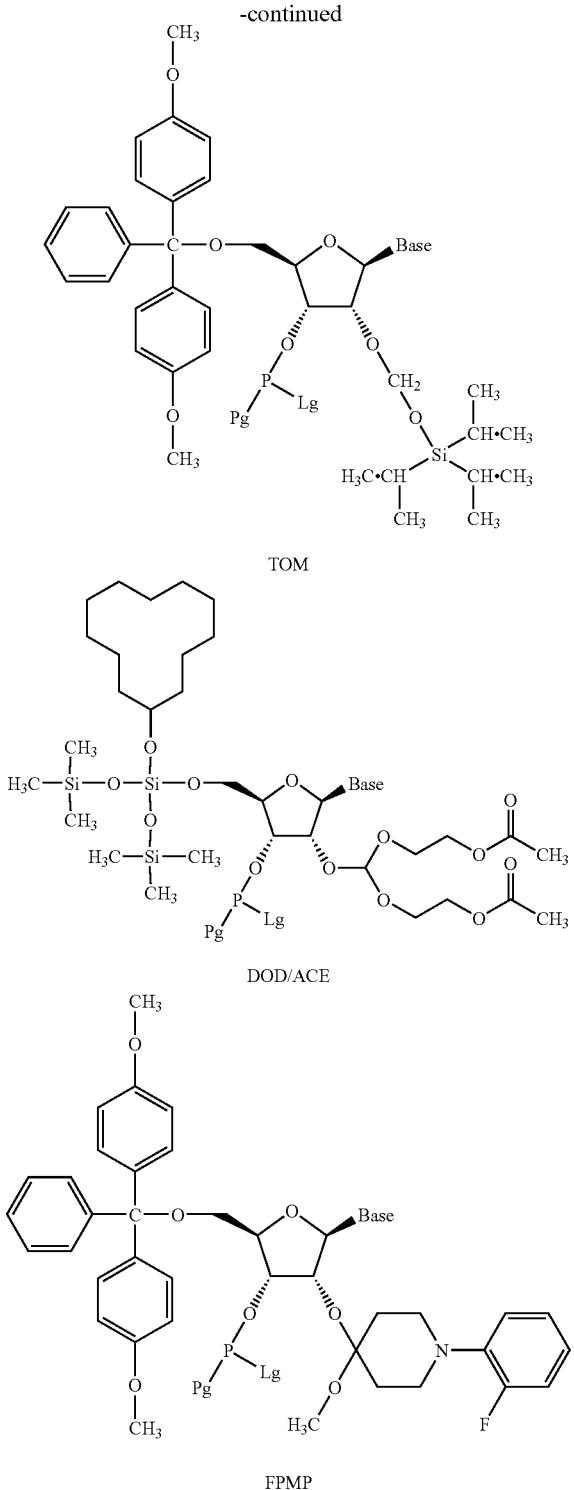

TOM

DOD/ACE

FPMP

All of the aforementioned RNA synthesis strategies are amenable to the present invention. Strategies that would be a hybrid of the above e.g. using a 5'-protecting group from one strategy with a 2'-O-protecting from another strategy is also amenable to the present invention.

The preparation of ribonucleotides and oligomeric compounds having at least one ribonucleoside incorporated and all the possible configurations falling in between these two extremes are encompassed by the present invention. The corresponding oligomeric compounds can be hybridized to further oligomeric compounds including oligoribonucleotides having regions of complementarity to form double-stranded (duplexed) oligomeric compounds.

The methods of preparing oligomeric compounds of the present invention can also be applied in the areas of drug discovery and target validation.

Oligonucleotide Isolation:

After cleavage from the controlled pore glass solid support and deblocking in concentrated ammonium hydroxide at 55° C. for 12-16 hours, the oligonucleotides or oligonucleosides are recovered by precipitation out of 1 M $NH_4OAc$ with >3 volumes of ethanol. Synthesized oligonucleotides were analyzed by electrospray mass spectroscopy (molecular weight determination) and by capillary gel electrophoresis and judged to be at least 70% full length material. The relative amounts of phosphorothioate and phosphodiester linkages obtained in the synthesis was determined by the ratio of correct molecular weight relative to the −16 amu product (+/−32 +/−48). For some studies oligonucleotides were purified by HPLC, as described by Chiang et al., *J. Biol. Chem.* 1991, 266, 18162-18171. Results obtained with HPLC-purified material were similar to those obtained with non-HPLC purified material.

Oligonucleotide Synthesis—96 Well Plate Format:

Oligonucleotides were synthesized via solid phase P(III) phosphoramidite chemistry on an automated synthesizer capable of assembling 96 sequences simultaneously in a 96-well format. Phosphodiester internucleotide linkages were afforded by oxidation with aqueous iodine. Phosphorothioate internucleotide linkages were generated by sulfurization utilizing 3,H-1,2 benzodithiole-3-one 1,1 dioxide (Beaucage Reagent) in anhydrous acetonitrile. Standard base-protected beta-cyanoethyl-diiso-propyl phosphoramidites were purchased from commercial vendors (e.g. PE-Applied Biosystems, Foster City, Calif., or Pharmacia, Piscataway, N.J.). Non-standard nucleosides are synthesized as per standard or patented methods. They are utilized as base protected beta-cyanoethyldiisopropyl phosphoramidites.

Oligonucleotides were cleaved from support and deprotected with concentrated $NH_4OH$ at elevated temperature (55-60° C.) for 12-16 hours and the released product then dried in vacuo. The dried product was then re-suspended in sterile water to afford a master plate from which all analytical and test plate samples are then diluted utilizing robotic pipettors.

Oligonucleotide Analysis—96-Well Plate Format:

The concentration of oligonucleotide in each well was assessed by dilution of samples and UV absorption spectroscopy. The full-length integrity of the individual products was evaluated by capillary electrophoresis (CE) in either the 96-well format (Beckman P/ACE™ MDQ) or, for individually prepared samples, on a commercial CE apparatus (e.g., Beckman P/ACE™ 5000, ABI 270). Base and backbone composition was confirmed by mass analysis of the oligomeric compounds utilizing electrospray-mass spectroscopy. All assay test plates were diluted from the master plate using single and multi-channel robotic pipettors. Plates were judged to be acceptable if at least 85% of the oligomeric compounds on the plate were at least 85% full length.

For double-stranded compounds of the invention, once synthesized, the complementary strands are annealed. The single strands are aliquoted and diluted to a concentration of 50 μM. Once diluted, 30 μL of each strand is combined with 15 µL of a 5× solution of annealing buffer. The final concentration of the buffer is 100 mM potassium acetate, 30 mM HEPES-KOH pH 7.4, and 2 mM magnesium acetate. The final volume is 75 µL. This solution is incubated for 1 minute at 90° C. and then centrifuged for 15 seconds. The tube is allowed to sit for 1 hour at 37° C. at which time the double-stranded compounds are used in experimentation. The final concentration of the duplexed compound is 20 µM. This solution can be stored frozen (−20° C.) and freeze-thawed up to 5 times.

Once prepared, the double-stranded compounds are evaluated for their ability to modulate target levels, expression or function. When cells reach 80% confluency, they are treated with synthetic double-stranded compounds comprising at least one oligomeric compound of the invention. For cells grown in 96-well plates, wells are washed once with 200 µL OPTI-MEM™-1 reduced-serum medium (Gibco BRL) and then treated with 130 µL of OPTI-MEM™-1 containing 12 µg/mL LIPOFECTIN™ (Invitrogen Corporation, Carlsbad, Calif.) and the desired double stranded compound at a final concentration of 200 nM. After 5 hours of treatment, the medium is replaced with fresh medium. Cells are harvested 16 hours after treatment, at which time RNA is isolated and target reduction measured by real-time RT-PCR.

Specific examples of oligomeric compounds useful in this invention include oligonucleotides containing modified e.g. non-naturally occurring internucleoside linkages. As defined in this specification, oligonucleotides having modified internucleoside linkages include internucleoside linkages that retain a phosphorus atom and internucleoside linkages that do not have a phosphorus atom. For the purposes of this specification, and as sometimes referenced in the art, modified oligonucleotides that do not have a phosphorus atom in their internucleoside backbone can also be considered to be oligonucleosides.

In the *C. elegans* system, modification of the internucleotide linkage (phosphorothioate) did not significantly interfere with RNAi activity. Based on this observation, it is suggested that certain oligomeric compounds of the invention can also have one or more modified internucleoside linkages. A suitable phosphorus-containing modified internucleoside linkage is the phosphorothioate internucleoside linkage.

Modified oligonucleotide backbones (internucleoside linkages) containing a phosphorus atom therein include, for example, phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, selenophosphates and boranophosphates having normal 3'-5' linkages, 2'-5' linked analogs of these, and those having inverted polarity wherein one or more internucleotide linkages is a 3' to 3', 5' to 5' or 2' to 2' linkage. Oligonucleotides having inverted polarity comprise a single 3' to 3' linkage at the 3'-most internucleotide linkage i.e. a single inverted nucleoside residue which may be abasic (the nucleobase is missing or has a hydroxyl group in place thereof). Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; 5,194,599; 5,565,555; 5,527,899; 5,721,218; 5,672,697 and 5,625,050, certain of which are commonly owned with this application, and each of which is herein incorporated by reference.

In other embodiments of the invention, oligomeric compounds have one or more phosphorothioate and/or heteroatom internucleoside linkages, in particular —$CH_2$—NH—O—$CH_2$—, —$CH_2$—N($CH_3$)—O—$CH_2$— (known as a methylene (methylimino) or MMI backbone), —$CH_2$—O—N($CH_3$)—$CH_2$—, —$CH_2$—N($CH_3$)—N($CH_3$)—$CH_2$— and —O—N($CH_3$)—$CH_2$—$CH_2$— (wherein the native phosphodiester internucleotide linkage is represented as —O—P(=O)(OH)—O—$CH_2$—). The MMI type internucleoside linkages are disclosed in the above referenced U.S. Pat. No. 5,489,677. Amide internucleoside linkages are disclosed in the above referenced U.S. Pat. No. 5,602,240.

Modified oligonucleotide backbones (internucleoside linkages) that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; 5,792,608; 5,646,269 and 5,677,439, certain of which are commonly owned with this application, and each of which is herein incorporated by reference.

Another group of oligomeric compounds amenable to the present invention includes oligonucleotide mimetics. The term mimetic as it is applied to oligonucleotides is intended to include oligomeric compounds wherein only the furanose ring or both the furanose ring and the internucleotide linkage are replaced with novel groups, replacement of only the furanose ring is also referred to in the art as being a sugar surrogate. The heterocyclic base moiety or a modified heterocyclic base moiety is maintained for hybridization with an appropriate target nucleic acid. One such oligomeric compound, an oligonucleotide mimetic that has been shown to have excellent hybridization properties, is referred to as a peptide nucleic acid (PNA). In PNA oligomeric compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA oligomeric compounds include, but are not limited to, U.S. Pat. Nos. 5,539,082; 5,714,331; and 5,719,262, each of which is herein incorporated by reference. Teaching of PNA oligomeric compounds can be found in Nielsen et al., *Science*, 1991, 254, 1497-1500.

PNA has been modified to incorporate numerous modifications since the basic PNA structure was first prepared. The basic structure is shown below:

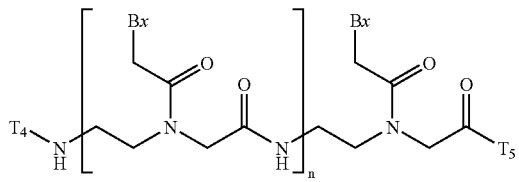

wherein

Bx is a heterocyclic base moiety;

T$_4$ is hydrogen, an amino protecting group, —C(O)R$_5$, substituted or unsubstituted C$_1$-C$_{10}$ alkyl, substituted or unsubstituted C$_2$-C$_{10}$ alkenyl, substituted or unsubstituted C$_2$-C$_{10}$ alkynyl, alkylsulfonyl, arylsulfonyl, a chemical functional group, a reporter group, a conjugate group, a D or L α-amino acid linked via the a-carboxyl group or optionally through the ω-carboxyl group when the amino acid is aspartic acid or glutamic acid or a peptide derived from D, L or mixed D and L amino acids linked through a carboxyl group, wherein the substituent groups are selected from hydroxyl, amino, alkoxy, carboxy, benzyl, phenyl, nitro, thiol, thioalkoxy, halogen, alkyl, aryl, alkenyl and alkynyl;

T$_5$ is —OH, —N(Z$_1$)Z$_2$, R$_5$, D or L α-amino acid linked via the α-amino group or optionally through the ω-amino group when the amino acid is lysine or ornithine or a peptide derived from D, L or mixed D and L amino acids linked through an amino group, a chemical functional group, a reporter group or a conjugate group;

Z$_1$ is hydrogen, C$_1$-C$_6$ alkyl, or an amino protecting group;

Z$_2$ is hydrogen, C$_1$-C$_6$ alkyl, an amino protecting group, —C(=O)—(CH$_2$)$_n$-J-Z$_3$, a D or L α-amino acid linked via the a-carboxyl group or optionally through the ω-carboxyl group when the amino acid is aspartic acid or glutamic acid or a peptide derived from D, L or mixed D and L amino acids linked through a carboxyl group;

Z$_3$ is hydrogen, an amino protecting group, —C$_1$-C$_6$ alkyl, —C(=O)—CH$_3$, benzyl, benzoyl, or —(CH$_2$)$_n$—N(H)Z$_1$;

each J is O, S or NH;

R$_5$ is a carbonyl protecting group; and n is from 2 to about 450.

Another class of oligonucleotide mimetic that has been studied is based on linked morpholino units (morpholino nucleic acid) having heterocyclic bases attached to the morpholino ring. A number of linking groups have been reported that link the morpholino monomeric units in a morpholino nucleic acid. A suitable class of linking groups have been selected to give a non-ionic oligomeric compound. The non-ionic morpholino-based oligomeric compounds are less likely to have undesired interactions with cellular proteins. Morpholino-based oligomeric compounds are non-ionic mimics of oligonucleotides which are less likely to form undesired interactions with cellular proteins (Dwaine A. Braasch and David R. Corey, Biochemistry, 2002, 41(14), 4503-4510). Morpholino-based oligomeric compounds are disclosed in U.S. Pat. No. 5,034,506, issued Jul. 23, 1991. The morpholino class of oligomeric compounds have been prepared having a variety of different linking groups joining the monomeric subunits.

Morpholino nucleic acids have been prepared having a variety of different linking groups (L$_2$) joining the monomeric subunits. The basic formula is shown below:

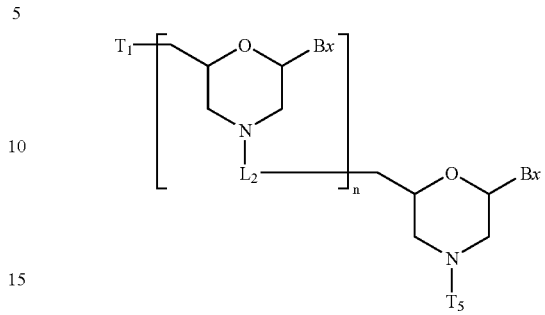

wherein

T$_1$ is hydroxyl or a protected hydroxyl;

T$_5$ is hydrogen or a phosphate or phosphate derivative;

L$_2$ is a linking group; and n is from 2 to about 450.

Another class of oligonucleotide mimetic is referred to as cyclohexenyl nucleic acids (CeNA). The furanose ring normally present in an DNA/RNA molecule is replaced with a cyclohenyl ring. CeNA DMT protected phosphoramidite monomers have been prepared and used for oligomeric compound synthesis following classical phosphoramidite chemistry. Fully modified CeNA oligomeric compounds and oligonucleotides having specific positions modified with CeNA have been prepared and studied (see Wang et al., J. Am. Chem. Soc., 2000, 122, 8595-8602). In general the incorporation of CeNA monomers into a DNA chain increases its stability of a DNA/RNA hybrid. CeNA oligoadenylates formed complexes with RNA and DNA complements with similar stability to the native complexes. The study of incorporating CeNA structures into natural nucleic acid structures was shown by NMR and circular dichroism to proceed with easy conformational adaptation. Furthermore the incorporation of CeNA into a sequence targeting RNA was stable to serum and able to activate E. coli RNase resulting in cleavage of the target RNA strand.

The general formula of CeNA is shown below:

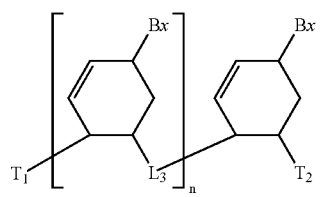

wherein each Bx is a heterocyclic base moiety;

T$_1$ is hydroxyl or a protected hydroxyl;

T$_2$ is hydroxyl or a protected hydroxyl;

L$_3$ is a linking group; and n is from 2 to about 450.

Another class of oligonucleotide mimetic (anhydrohexitol nucleic acid) can be prepared from one or more anhydrohexitol nucleosides (see, Wouters and Herdewijn, Bioorg. Med.

Chem. Lett., 1999, 9, 1563-1566) and would have the general formula:

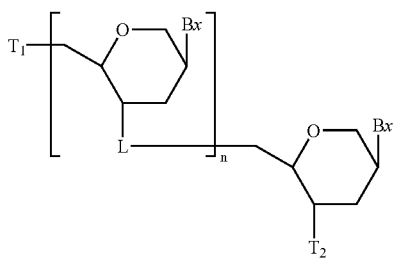

Another group of modifications includes nucleosides having sugar moieties that are bicyclic thereby locking the sugar conformational geometry. The most studied of these nucleosides is a bicyclic sugar moiety having a 4'-CH$_2$—O-2' bridge. As can be seen in the structure below the 2'-O— has been linked via a methylene group to the 4' carbon. This bridge attaches under the sugar as shown forcing the sugar ring into a locked 3'-endo conformation geometry. The ∀-L nucleoside has also been reported wherein the linkage is above the ring and the heterocyclic base is in the ∀ rather than the ∃-conformation (see U.S. patent application Publication No. application 2003/0087230). The xylo analog has also been prepared (see U.S. patent application Publication No. 2003/0082807). The preferred bridge for a locked nucleic acid (LNA) is 4'-(—CH$_2$—)$_n$—O-2' wherein n is 1 or 2. The literature is confusing when the term locked nucleic acid is used but in general locked nucleic acids refers to n=1, ENA™ refers to n=2 (Kaneko et al., U.S. patent application Publication No. US 2002/0147332, Singh et al., Chem. Commun., 1998, 4, 455-456, also see U.S. Pat. Nos. 6,268,490 and 6,670,461 and U.S. patent application Publication No. US 2003/0207841). However the term locked nucleic acids can also be used in a more general sense to describe any bicyclic sugar moiety that has a locked conformation.

ENA™ along with LNA (n=1) have been studied more than the myriad of other analogs. Oligomeric compounds incorporating LNA and ENA analogs display very high duplex thermal stabilities with complementary DNA and RNA (Tm=+3 to +10 C), stability towards 3'-exonucleolytic degradation and good solubility properties.

The basic structure of LNA showing the bicyclic ring system is shown below:

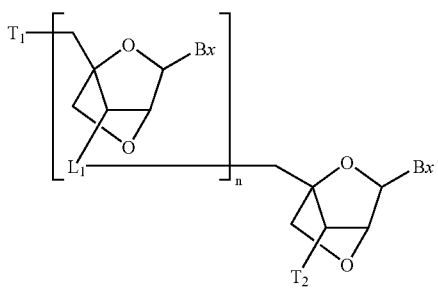

wherein
each Bx is a heterocyclic base moiety;
each L$_1$ is an internucleoside linking group;
T$_1$ is hydroxyl or a protected hydroxyl;
T$_2$ is hydroxyl or a protected hydroxyl, and
n is from 1 to about 80.

The conformations of LNAs determined by 2D NMR spectroscopy have shown that the locked orientation of the LNA nucleotides, both in single-stranded LNA and in duplexes, constrains the phosphate backbone in such a way as to introduce a higher population of the N-type conformation (Petersen et al., J. Mol. Recognit., 2000, 13, 44-53). These conformations are associated with improved stacking of the nucleobases (Wengel et al., Nucleosides Nucleotides, 1999, 18, 1365-1370).

LNA has been shown to form exceedingly stable LNA: LNA duplexes (Koshkin et al., J. Am. Chem. Soc., 1998, 120, 13252-13253). LNA:LNA hybridization was shown to be the most thermally stable nucleic acid type duplex system, and the RNA-mimicking character of LNA was established at the duplex level. Introduction of 3 LNA monomers (T or A) significantly increased melting points (Tm=+15/+11) toward DNA complements. The universality of LNA-mediated hybridization has been stressed by the formation of exceedingly stable LNA:LNA duplexes. The RNA-mimicking of LNA was reflected with regard to the N-type conformational restriction of the monomers and to the secondary structure of the LNA:RNA duplex.

LNAs also form duplexes with complementary DNA, RNA or LNA with high thermal affinities. Circular dichroism (CD) spectra show that duplexes involving fully modified LNA (esp. LNA:RNA) structurally resemble an A-form RNA:RNA duplex. Nuclear magnetic resonance (NMR) examination of an LNA:DNA duplex confirmed the 3'-endo conformation of an LNA monomer. Recognition of double-stranded DNA has also been demonstrated suggesting strand invasion by LNA. Studies of mismatched sequences show that LNAs obey the Watson-Crick base pairing rules with generally improved selectivity compared to the corresponding unmodified reference strands.

Novel types of LNA-oligomeric compounds, as well as the LNAs, are useful in a wide range of diagnostic and therapeutic applications. Among these are antisense applications, PCR applications, strand-displacement oligomers, substrates for nucleic acid polymerases and generally as nucleotide based drugs.

Potent and nontoxic antisense oligonucleotides containing LNAs have been described (Wahlestedt et al., Proc. Natl. Acad. Sci. U.S.A., 2000, 97, 5633-5638.) The authors have demonstrated that LNAs confer several desired properties to antisense agents. LNA/DNA copolymers were not degraded readily in blood serum and cell extracts. LNA/DNA copolymers exhibited potent antisense activity in assay systems as disparate as G-protein-coupled receptor signaling in living rat brain and detection of reporter genes in *Escherichia coli*. LIPOFECTIN™-mediated efficient delivery of LNA into living human breast cancer cells has also been accomplished.

The synthesis and preparation of the LNA monomers adenine, cytosine, guanine, 5-methyl-cytosine, thymine and uracil, along with their oligomerization, and nucleic acid recognition properties have been described (Koshkin et al., Tetrahedron, 1998, 54, 3607-3630). LNAs and preparation thereof are also described in WO 98/39352 and WO 99/14226.

The first analogs of LNA, phosphorothioate-LNA and 2'-thio-LNAs, have also been prepared (Kumar et al., Bioorg. Med. Chem. Lett., 1998, 8, 2219-2222). Preparation of locked nucleoside analogs containing oligodeoxyribonucleotide duplexes as substrates for nucleic acid polymerases has also been described (Wengel et al., PCT International Application WO 98-DK393 19980914). Furthermore, synthesis of 2'-amino-LNA, a novel conformationally restricted high-affinity oligonucleotide analog with a handle has been described in the art (Singh et al., J. Org. Chem., 1998, 63, 10035-10039). In addition, 2'-Amino- and 2'-methylamino-LNA's have been prepared and the thermal stability of their duplexes with complementary RNA and DNA strands has been previously reported.

Some oligonucleotide mimetics have been prepared to include bicyclic and tricyclic nucleoside analogs having the formulas (amidite monomers shown):

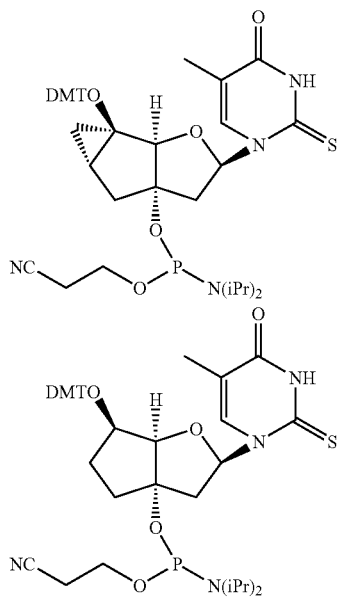

(see Steffens et al., Helv. Chim. Acta, 1997, 80, 2426-2439; Steffens et al., J. Am. Chem. Soc., 1999, 121, 3249-3255; and Renneberg et al., J. Am. Chem. Soc., 2002, 124, 5993-6002). These modified nucleoside analogs have been oligomerized using the phosphoramidite approach and the resulting oligomeric compounds containing tricyclic nucleoside analogs have shown increased thermal stabilities (Tm's) when hybridized to DNA, RNA and itself. Oligomeric compounds containing bicyclic nucleoside analogs have shown thermal stabilities approaching that of DNA duplexes.

Another class of oligonucleotide mimetic is referred to as phosphonomonoester nucleic acid and incorporates a phosphorus group in the backbone. This class of olignucleotide mimetic is reported to have useful physical and biological and pharmacological properties in the areas of inhibiting gene expression (antisense oligonucleotides, ribozymes, sense oligonucleotides and triplex-forming oligonucleotides), as probes for the detection of nucleic acids and as auxiliaries for use in molecular biology.

The general formula (for definitions of Markush variables see: U.S. Pat. Nos. 5,874,553 and 6,127,346 herein incorporated by reference in their entirety) is shown below.

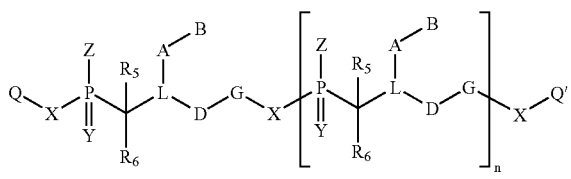

Another oligonucleotide mimetic has been reported wherein the furanosyl ring has been replaced by a cyclobutyl moiety.

Modified Sugars

Oligomeric compounds of the invention may also contain one or more substituted sugar moieties. These oligomeric compounds comprise a sugar substituent group selected from: OH; F; O—, S—, or N-alkyl; O—, S—, or N-alkenyl; O—, S— or N-alkynyl; or O-alkyl-O-alkyl, wherein the alkyl, alkenyl and alkynyl may be substituted or unsubstituted $C_1$ to $C_{10}$ alkyl or $C_2$ to C  alkenyl and alkynyl. Particularly suitable are $O((CH_2)_nO)_mCH_3$, $O(CH_2)_nOCH_3$, $O(CH_2)_nNH_2$, $O(CH_2)_nCH_3$, $O(CH_2)_nONH_2$, and $O(CH_2)_nON((CH_2)_nCH_3)_2$, where n and m are from 1 to about 10. Some oligonucleotides comprise a sugar substituent group selected from: $C_1$ to $C_{10}$ lower alkyl, substituted lower alkyl, alkenyl, alkynyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. One modification includes 2'-methoxyethoxy (2'-O—$CH_2CH_2OCH_3$, also known as 2'-O-(2-methoxyethyl) or 2'-MOE) (Martin et al., Helv. Chim. Acta, 1995, 78, 486-504) i.e., an alkoxyalkoxy group. One modification includes 2'-dimethylaminooxyethoxy, i.e., a $O(CH_2)_2ON(CH_3)_2$ group, also known as 2'-DMAOE, as described in examples hereinbelow, and 2'-dimethylaminoethoxyethoxy (also known in the art as 2'-O-dimethyl-amino-ethoxy-ethyl or 2'-DMAEOE), i.e., 2'-O—$CH_2$—O—$CH_2$—$N(CH_3)_2$.

Other sugar substituent groups include methoxy (—O—$CH_3$), aminopropoxy (—$OCH_2CH_2CH_2NH_2$), allyl (—$CH_2$—CH=$CH_2$), —O-allyl (—O—$CH_2$—CH=$CH_2$) and fluoro (F). 2'-Sugar substituent groups may be in the arabino (up) position or ribo (down) position. One 2'-arabino modification is 2'-F. Similar modifications may also be made at other positions on the oligomeric compound, particularly the 3' position of the sugar on the 3' terminal nucleoside or in 2'-5' linked oligonucleotides and the 5' position of 5' terminal nucleotide. Oligomeric compounds may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; 5,792,747; and 5,700,920, certain of which are commonly owned with the instant application, and each of which is herein incorporated by reference in its entirety.

Representative sugar substituent groups include groups of formula $I_a$ or $II_a$:

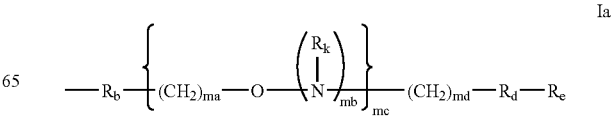

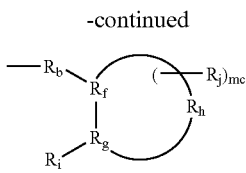

wherein:
R$_b$ is O, S or NH;
R$_d$ is a single bond, O, S or C(=O);
R$_e$ is C$_1$-C$_{10}$ alkyl, N(R$_k$)(R$_m$), N(R$_k$)(R$_n$), N=C(R$_p$)(R$_q$), N=C(R$_p$)(R$_r$) or has formula III$_a$;

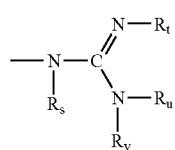

R$_p$ and R$_q$ are each independently hydrogen or C$_1$-C$_{10}$ alkyl;
R$_r$ is —R$_x$—R$_y$;
each R$_s$, R$_t$, R$_u$ and R$_v$ is, independently, hydrogen, C(O)R$_w$, substituted or unsubstituted C$_1$-C$_{10}$ alkyl, substituted or unsubstituted C$_2$-C$_{10}$ alkenyl, substituted or unsubstituted C$_2$-C$_{10}$ alkynyl, alkylsulfonyl, arylsulfonyl, a chemical functional group or a conjugate group, wherein the substituent groups are selected from hydroxyl, amino, alkoxy, carboxy, benzyl, phenyl, nitro, thiol, thioalkoxy, halogen, alkyl, aryl, alkenyl and alkynyl;
or optionally, R$_u$ and R$_v$, together form a phthalimido moiety with the nitrogen atom to which they are attached;
each R$_w$ is, independently, substituted or unsubstituted C$_1$-C$_{10}$ alkyl, trifluoromethyl, cyanoethyloxy, methoxy, ethoxy, t-butoxy, allyloxy, 9-fluorenylmethoxy, 2-(trimethylsilyl)-ethoxy, 2,2,2-trichloroethoxy, benzyloxy, butyryl, isobutyryl, phenyl or aryl;
R$_k$ is hydrogen, a nitrogen protecting group or —R$_x$—R$_y$;
R$_p$ is hydrogen, a nitrogen protecting group or —R$_x$—R$_y$;
R$_x$ is a bond or a linking moiety;
R$_y$ is a chemical functional group, a conjugate group or a solid support medium;
each R$_m$ and R$_n$ is, independently, H, a nitrogen protecting group, substituted or unsubstituted C$_1$-C$_{10}$ alkyl, substituted or unsubstituted C$_2$-C$_{10}$ alkenyl, substituted or unsubstituted C$_2$-C$_{10}$ alkynyl, wherein the substituent groups are selected from hydroxyl, amino, alkoxy, carboxy, benzyl, phenyl, nitro, thiol, thioalkoxy, halogen, alkyl, aryl, alkenyl, alkynyl; NH$_3^+$, N(R$_u$)(R$_v$), guanidino and acyl where said acyl is an acid amide or an ester;
or R$_m$ and R$_n$, together, are a nitrogen protecting group, are joined in a ring structure that optionally includes an additional heteroatom selected from N and O or are a chemical functional group;
R$_i$ is OR$_z$, SR$_z$, or N(R$_z$)$_2$;
each R$_z$ is, independently, H, C$_1$-C$_8$ alkyl, C$_1$-C$_8$ haloalkyl, C(=NH)N(H)R$_u$, C(=O)N(H)R$_u$ or OC(=O)N(H)R$_u$;
R$_f$, R$_g$ and R$_h$ comprise a ring system having from about 4 to about 7 carbon atoms or having from about 3 to about 6 carbon atoms and 1 or 2 heteroatoms wherein said heteroatoms are selected from oxygen, nitrogen and sulfur and wherein said ring system is aliphatic, unsaturated aliphatic, aromatic, or saturated or unsaturated heterocyclic;
R$_j$ is alkyl or haloalkyl having 1 to about 10 carbon atoms, alkenyl having 2 to about 10 carbon atoms, alkynyl having 2 to about 10 carbon atoms, aryl having 6 to about 14 carbon atoms, N(R$_k$)(R$_m$) OR$_k$, halo, SR$_k$ or CN;
m$_a$ is 1 to about 10;
each mb is, independently, 0 or 1;
mc is 0 or an integer from 1 to 10;
md is an integer from 1 to 10;
me is from 0, 1 or 2; and
provided that when mc is 0, md is greater than 1.

Representative substituents groups are disclosed in U.S. patent application Ser. No. 09/130,973, filed Aug. 7, 1998, entitled "Capped 2'-Oxyethoxy Oligonucleotides," hereby incorporated by reference in its entirety.

Representative cyclic substituent groups are disclosed in U.S. patent application Ser. No. 09/123,108, filed Jul. 27, 1998, entitled "RNA Targeted 2'-Oligomeric compounds that are Conformationally Preorganized," hereby incorporated by reference in its entirety.

Particular sugar substituent groups include O((CH$_2$)$_n$O)$_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON((CH$_2$)$_n$CH$_3$))$_2$, where n and m are from 1 to about 10.

Representative guanidino substituent groups are disclosed in U.S. patent application Ser. No. 09/349,040, entitled "Functionalized Oligomers," filed Jul. 7, 1999, hereby incorporated by reference in its entirety.

Representative acetamido substituent groups are disclosed in U.S. Pat. No. 6,147,200 which is hereby incorporated by reference in its entirety.

Representative dimethylaminoethyloxyethyl substituent groups are disclosed in International Patent Application PCT/US99/17895, entitled "2'-O-Dimethylaminoethyloxyethyl-Oligomeric compounds", filed Aug. 6, 1999, hereby incorporated by reference in its entirety.

Synthesis of Chimeric Oligonucleotides:

Chimeric oligonucleotides, oligonucleosides or mixed oligonucleotides/oligonucleosides of the invention can be of several different types. These include a first type wherein the "gap" segment of linked nucleosides is positioned between 5' and 3' "wing" segments of linked nucleosides and a second "open end" type wherein the "gap" segment is located at either the 3' or the 5' terminus of the oligomeric compound. Oligonucleotides of the first type are also known in the art as "gapmers" or gapped oligonucleotides. Oligonucleotides of the second type are also known in the art as "hemimers" or "wingmers."

(2'-O-Me)-(2'-deoxy)-(2'-O-Me)Chimeric Phosphorothioate Oligonucleotides

Chimeric oligonucleotides having 2'-O-alkyl phosphorothioate and 2'-deoxy phosphorothioate oligonucleotide segments are synthesized using an Applied Biosystems automated DNA synthesizer Model 394, as above. Oligonucleotides are synthesized using the automated synthesizer and 2'-deoxy-5'-dimethoxytrityl-3'-O-phosphoramidite for the DNA portion and 5'-dimethoxytrityl-2'-O-methyl-3'-O-phosphoramidite for 5' and 3' wings. The standard synthesis cycle is modified by incorporating coupling steps with increased reaction times for the 5'-dimethoxytrityl-2'-O-methyl-3'-O-phosphoramidite. The fully protected oligonucleotide is cleaved from the support and deprotected in concentrated ammonia (NH$_4$OH) for 12-16 hr at 55° C. The deprotected

(2'-O-(2-Methoxyethyl)-(2'-deoxy)-(2'-O-(Methoxyethyl))Chimeric Phosphorothioate Oligonucleotides (2'-O-(2-methoxyethyl))-(2'-deoxy)-(-2'-O-(methoxyethyl))chimeric phosphorothioate oligonucleotides were prepared as per the procedure above for the 2'-O-methyl chimeric oligonucleotide, with the substitution of 2'-O-(methoxyethyl) amidites for the 2'-O-methyl amidites.

(2'-O-(2-Methoxyethyl)Phosphodiester)-(2'-deoxy Phosphorothioate)-(2'-O-(2-Methoxyethyl)Phosphodiester)Chimeric Oligonucleotides (2'-O-(2-methoxyethyl phosphodiester)-(2'-deoxy phosphorothioate)-(2'-O-(methoxyethyl)phosphodiester)chimeric oligonucleotides are prepared as per the above procedure for the 2'-O-methyl chimeric oligonucleotide with the substitution of 2'-O-(methoxyethyl)amidities for the 2'-O-methyl amidites, oxidation with iodine to generate the phosphodiester internucleotide linkages within the wing portions of the chimeric structures and sulfurization utilizing 3,H-1,2 benzodithiole-3-one 1,1 dioxide (Beaucage Reagent) to generate the phosphorothioate internucleotide linkages for the center gap.

Other chimeric oligonucleotides, chimeric oligonucleosides and mixed chimeric oligonucleotides/oligonucleosides are synthesized according to U.S. Pat. No. 5,623,065, herein incorporated by reference.

The terms used to describe the conformational geometry of homoduplex nucleic acids are "A Form" for RNA and "B Form" for DNA. The respective conformational geometry for RNA and DNA duplexes was determined from X-ray diffraction analysis of nucleic acid fibers (Arnott and Hukins, Biochem. Biophys. Res. Comm., 1970, 47, 1504.) In general, RNA:RNA duplexes are more stable and have higher melting temperatures (Tm's) than DNA:DNA duplexes (Sanger et al., Principles of Nucleic Acid Structure, 1984, Springer-Verlag; New York, N.Y.; Lesnik et al., Biochemistry, 1995, 34, 10807-10815; Conte et al., Nucleic Acids Res., 1997, 25, 2627-2634). The increased stability of RNA has been attributed to several structural features, most notably the improved base stacking interactions that result from an A-form geometry (Searle et al., Nucleic Acids Res., 1993, 21, 2051-2056). The presence of the 2' hydroxyl in RNA biases the sugar toward a C3' endo pucker, i.e., also designated as Northern pucker, which causes the duplex to favor the A-form geometry. In addition, the 2' hydroxyl groups of RNA can form a network of water mediated hydrogen bonds that help stabilize the RNA duplex (Egli et al., Biochemistry, 1996, 35, 8489-8494). On the other hand, deoxy nucleic acids prefer a C2' endo sugar pucker, i.e., also known as Southern pucker, which is thought to impart a less stable B-form geometry (Sanger, W. (1984) Principles of Nucleic Acid Structure, Springer-Verlag, New York, N.Y.). As used herein, B-form geometry is inclusive of both C2'-endo pucker and O4'-endo pucker. This is consistent with Berger, et. al., Nucleic Acids Research, 1998, 26, 2473-2480, who pointed out that in considering the furanose conformations which give rise to B-form duplexes consideration should also be given to a O4'-endo pucker contribution.

DNA:RNA hybrid duplexes, however, are usually less stable than pure RNA:RNA duplexes, and depending on their sequence may be either more or less stable than DNA:DNA duplexes (Searle et al., Nucleic Acids Res., 1993, 21, 2051-2056). The structure of a hybrid duplex is intermediate between A- and B-form geometries, which may result in poor stacking interactions (Lane et al., Eur. J. Biochem., 1993, 215, 297-306; Fedoroff et al., J. Mol. Biol., 1993, 233, 509-523; Gonzalez et al., Biochemistry, 1995, 34, 4969-4982; Horton et al., J. Mol. Biol., 1996, 264, 521-533). The stability of the duplex formed between a target RNA and a synthetic sequence is central to therapies such as, but not limited to, antisense mechanisms, including RNase H-mediated and RNA interference mechanisms, as these mechanisms involved the hybridization of a synthetic sequence strand to an RNA target strand. In the case of RNase H, effective inhibition of the mRNA requires that the antisense sequence achieve at least a threshold of hybridization.

One routinely used method of modifying the sugar puckering is the substitution of the sugar at the 2'-position with a substituent group that influences the sugar geometry. The influence on ring conformation is dependent on the nature of the substituent at the 2'-position. A number of different substituents have been studied to determine their sugar puckering effect. For example, 2'-halogens have been studied showing that the 2'-fluoro derivative exhibits the largest population (65%) of the C3'-endo form, and the 2'-iodo exhibits the lowest population (7%). The populations of adenosine (2'-OH) versus deoxyadenosine (2'-H) are 36% and 19%, respectively. Furthermore, the effect of the 2'-fluoro group of adenosine dimers (2'-deoxy-2'-fluoroadenosine-2'-deoxy-2'-fluoro-adenosine) is also correlated to the stabilization of the stacked conformation.

As expected, the relative duplex stability can be enhanced by replacement of 2'-OH groups with 2'-F groups thereby increasing the C3'-endo population. It is assumed that the highly polar nature of the 2'-F bond and the extreme preference for C3'-endo puckering may stabilize the stacked conformation in an A-form duplex. Data from UV hypochromicity, circular dichroism, and $^1$H NMR also indicate that the degree of stacking decreases as the electronegativity of the halo substituent decreases. Furthermore, steric bulk at the 2'-position of the sugar moiety is better accommodated in an A-form duplex than a B-form duplex. Thus, a 2'-substituent on the 3'-terminus of a dinucleoside monophosphate is thought to exert a number of effects on the stacking conformation: steric repulsion, furanose puckering preference, electrostatic repulsion, hydrophobic attraction, and hydrogen bonding capabilities. These substituent effects are thought to be determined by the molecular size, electronegativity, and hydrophobicity of the substituent. Melting temperatures of complementary strands is also increased with the 2'-substituted adenosine diphosphates. It is not clear whether the 3'-endo preference of the conformation or the presence of the substituent is responsible for the increased binding. However, greater overlap of adjacent bases (stacking) can be achieved with the 3'-endo conformation.

Nucleoside conformation is influenced by various factors including substitution at the 2', 3' or 4'-positions of the pentofuranosyl sugar. Electronegative substituents generally prefer the axial positions, while sterically demanding substituents generally prefer the equatorial positions (Principles of Nucleic Acid Structure, Wolfgang Sanger, 1984, Springer-Verlag.) Modification of the 2' position to favor the 3'-endo conformation can be achieved while maintaining the 2'-OH as a recognition element, as illustrated in FIG. 2, below (Gallo et al., Tetrahedron (2001), 57, 5707-5713. Harry-O'kuru et al., J. Org. Chem., (1997), 62(6), 1754-1759 and Tang et al., J. Org. Chem. (1999), 64, 747-754.) Alternatively, preference for the 3'-endo conformation can be achieved by deletion of the 2'-OH as exemplified by 2'deoxy-2'F-nucleosides (Kawasaki et al., J. Med. Chem. (1993), 36, 831-841), which adopts the 3'-endo conformation positioning the electronegative fluorine atom in the axial position. Other modifications of the ribose ring, for example substitution at the 4'-position to give 4'-F modified nucleosides (Guillerm et al., Bioorganic and Medicinal Chemistry Letters (1995), 5, 1455-1460 and Owen et al., J. Org. Chem. (1976), 41, 3010-3017), or for example modification to yield methanocarba nucleoside analogs (Jacobson et al., J. Med. Chem. Lett. (2000), 43, 2196-2203 and Lee et al., Bioorganic and Medicinal Chemistry Letters (2001), 11, 1333-1337) also induce preference for the 3'-endo conformation.

In one aspect of the present invention oligomeric compounds include nucleosides synthetically modified to induce a 3'-endo sugar conformation. A nucleoside can incorporate synthetic modifications of the heterocyclic base, the sugar moiety or both to induce a desired 3'-endo sugar conformation. These modified nucleosides are used to mimic RNA-like nucleosides so that particular properties of an oligomeric compound can be enhanced while maintaining the desirable 3'-endo conformational geometry (see Scheme 1). There is an apparent preference for an RNA type duplex (A form helix, predominantly 3'-endo) as a requirement (e.g. trigger) of RNA interference which is supported in part by the fact that duplexes composed of 2'-deoxy-2'-F-nucleosides appears efficient in triggering RNAi response in the *C. elegans* system. Properties that are enhanced by using more stable 3'-endo nucleosides include but aren't limited to modulation of pharmacokinetic properties through modification of protein binding, protein off-rate, absorption and clearance; modulation of nuclease stability as well as chemical stability; modulation of the binding affinity and specificity of the oligomer (affinity and specificity for enzymes as well as for complementary sequences); and increasing efficacy of RNA cleavage. The present invention provides oligomeric compounds designed to act as triggers of RNAi having one or more nucleosides modified in such a way as to favor a C3'-endo type conformation.

Scheme 1

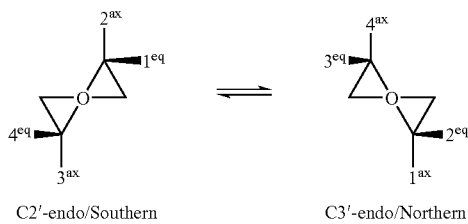

C2'-endo/Southern     C3'-endo/Northern

Along similar lines, oligomeric triggers of RNAi response might be composed of one or more nucleosides modified in such a way that conformation is locked into a C3'-endo type conformation, i.e. Locked Nucleic Acid (LNA, Singh et al, Chem. Commun. (1998), 4, 455-456), and ethylene bridged Nucleic Acids (ENA, Morita et al, Bioorganic & Medicinal Chemistry Letters (2002), 12, 73-76.) Examples of modified nucleosides amenable to the present invention are shown below. These examples are meant to be representative and not exhaustive.

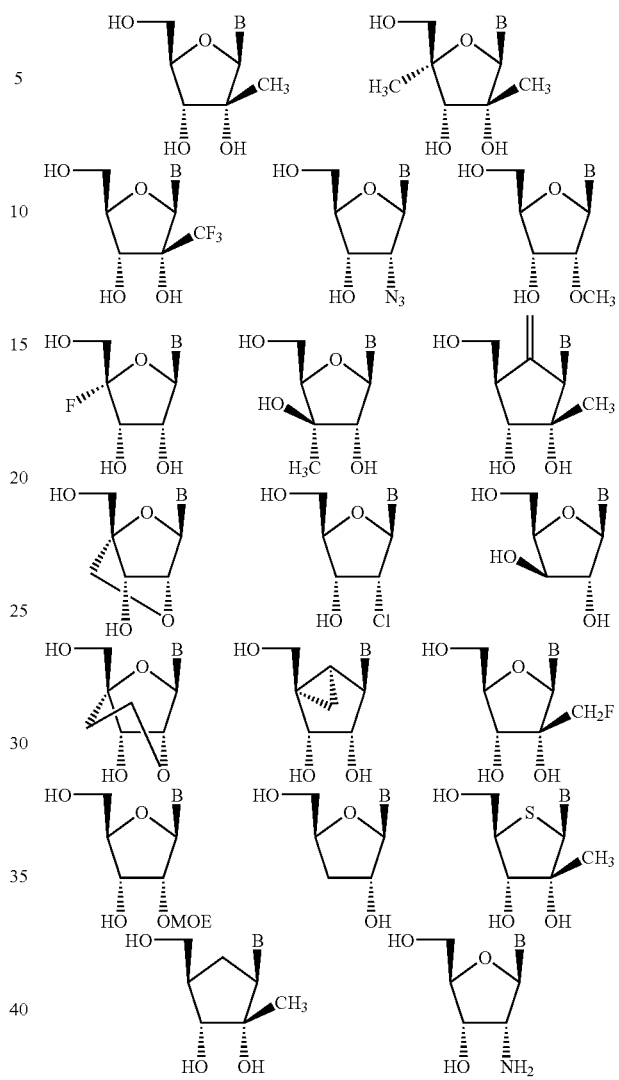

Oligomeric compounds may also include nucleobase (often referred to in the art simply as "base" or "heterocyclic base moiety") modifications or substitutions. As used herein, "unmodified" or "natural" nucleobases include the purine bases adenine (A) and guanine (G), and the pyrimidine bases thymine (T), cytosine (C) and uracil (U). Modified nucleobases also referred herein as heterocyclic base moieties include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH$_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties may also include those in which the purine or pyrimidine base is replaced with other heterocycles, for example 7-deaza-adenine, 7-deazaguanosine, 2-aminopyridine and 2-pyridone. Some nucleobases include those disclosed in U.S. Pat. No. 3,687,808, those disclosed in *The Concise Encyclopedia Of Polymer Science And Engineering*, pages 858-859, Kroschwitz, J. I., ed. John Wiley & Sons, 1990, those disclosed by Englisch et al., *Angewandte Chemie*, International Edition, 1991, 30, 613, and those disclosed by Sanghvi, Y. S., Chapter 15, *Antisense Research and Applications*, pages 289-302, Crooke, S. T. and Lebleu, B., ed., CRC Press, 1993. Certain of these nucleobases are particularly useful for increasing the binding affinity of the oligomeric compounds of the invention. These include 5-substituted pyrimidines, 6-azapyrimidines and N-2, N-6 and O-6 substituted purines, including 2 aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds., *Antisense Research and Applications*, CRC Press, Boca Raton, 1993, pp. 276-278) and are presently preferred base substitutions, even more particularly when combined with 2'-O-methoxyethyl sugar modifications.

In one aspect of the present invention oligomeric compounds are prepared having polycyclic heterocyclic compounds in place of one or more heterocyclic base moieties. A number of tricyclic heterocyclic compounds have been previously reported. These compounds are routinely used in antisense applications to increase the binding properties of the modified strand to a target strand. The most studied modifications are targeted to guanosines hence they have been termed G-clamps or cytidine analogs. Many of these polycyclic heterocyclic compounds have the general formula:

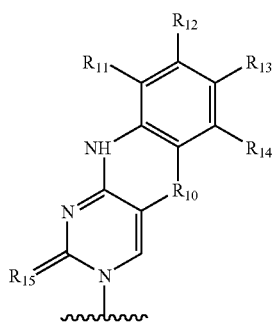

Representative cytosine analogs that make 3 hydrogen bonds with a guanosine in a second strand include 1,3-diazaphenoxazine-2-one ($R_{10}$=O, $R_{11}$—$R_{14}$=H) (Kurchavov, et al., *Nucleosides and Nucleotides*, 1997, 16, 1837-1846), 1,3-diazaphenothiazine-2-one ($R_{10}$=S, $R_{11}$—$R_4$=H), (Lin, K.-Y.; Jones, R. J.; Matteucci, M. *J. Am. Chem. Soc.* 1995, 117, 3873-3874) and 6,7,8,9-tetrafluoro-1,3-diazaphenoxazine-2-one ($R_{10}$=O, $R_{11}$—$R_{14}$=F) (Wang, J.; Lin, K.-Y., Matteucci, M. *Tetrahedron Lett.* 1998, 39, 8385-8388). When incorporated into oligonucleotides, these base modifications were shown to hybridize with complementary guanine and the latter was also shown to hybridize with adenine and to enhance helical thermal stability by extended stacking interactions (also see U.S. patent application Publication 20030207804 and U.S. patent application Publication 20030175906, both of which are incorporated herein by reference in their entirety).

Helix-stabilizing properties have been observed when a cytosine analog/substitute has an aminoethoxy moiety attached to the rigid 1,3-diazaphenoxazine-2-one scaffold ($R_{10}$=O, $R_{11}$=—O—$(CH_2)_2$—$NH_2$, $R_{12-14}$=H ) (Lin, K.-Y.; Matteucci, M. *J. Am. Chem. Soc.* 1998, 120, 8531-8532). Binding studies demonstrated that a single incorporation could enhance the binding affinity of a model oligonucleotide to its complementary target DNA or RNA with a $\Delta T_m$ of up to 18° relative to 5-methyl cytosine ($dC5^{me}$), which is the highest known affinity enhancement for a single modification. On the other hand, the gain in helical stability does not compromise the specificity of the oligonucleotides. The $T_m$ data indicate an even greater discrimination between the perfect match and mismatched sequences compared to $dC5^{me}$. It was suggested that the tethered amino group serves as an additional hydrogen bond donor to interact with the Hoogsteen face, namely the O6, of a complementary guanine thereby forming 4 hydrogen bonds. This means that the increased affinity of G-clamp is mediated by the combination of extended base stacking and additional specific hydrogen bonding.

Tricyclic heterocyclic compounds and methods of using them that are amenable to the present invention are disclosed in U.S. Pat. No. 6,028,183, and U.S. Pat. No. 6,007,992, the contents of both are incorporated herein in their entirety.

The enhanced binding affinity of the phenoxazine derivatives together with their sequence specificity makes them valuable nucleobase analogs for the development of more potent antisense-based drugs. In fact, promising data have been derived from in vitro experiments demonstrating that heptanucleotides containing phenoxazine substitutions can activate RNaseH, enhance cellular uptake and exhibit an increased antisense activity (Lin, K-Y; Matteucci, M. *J. Am. Chem. Soc.* 1998, 120, 8531-8532). The activity enhancement was even more pronounced in case of G-clamp, as a single substitution was shown to significantly improve the in vitro potency of a 20mer 2'-deoxyphosphorothioate oligonucleotides (Flanagan, W. M.; Wolf, J. J.; Olson, P.; Grant, D.; Lin, K.-Y.; Wagner, R. W.; Matteucci, M. *Proc. Natl. Acad. Sci. USA*, 1999, 96, 3513-3518).

Modified polycyclic heterocyclic compounds useful as heterocyclic bases are disclosed in but not limited to, the above noted U.S. Pat. No. 3,687,808, as well as U.S. Pat. Nos. 4,845,205; 5,130,302; 5,134,066; 5,175,273; 5,367,066; 5,432,272; 5,434,257; 5,457,187; 5,459,255; 5,484,908; 5,502,177; 5,525,711; 5,552,540; 5,587,469; 5,594,121; 5,596,091; 5,614,617; 5,645,985; 5,646,269; 5,750,692; 5,830,653; 5,763,588; 6,005,096; and 5,681,941, and U.S. patent application Publication No. 20030158403, each of which is incorporated herein by reference in its entirety.

One substitution that can be appended to the oligomeric compounds of the invention involves the linkage of one or more moieties or conjugates which enhance the activity, cellular distribution or cellular uptake of the resulting oligomeric compounds. In one embodiment such modified oligomeric compounds are prepared by covalently attaching conjugate groups to functional groups such as hydroxyl or amino groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugates groups include cholesterols, carbohydrates, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve oligomer uptake, enhance oligomer resistance to degradation, and/or strengthen hybridization with RNA. Groups that enhance the pharmacokinetic properties, in the context of this invention, include groups that improve oligomer uptake, distribution, metabolism or excretion. Representative conjugate groups are disclosed in International Patent Application PCT/US92/09196, filed Oct. 23, 1992 the entire disclosure of which is incorporated herein by reference. Conjugate moieties include but are not limited to lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-oxycholesterol moiety (Crooke et al., J. Pharmacol. Exp. Ther., 1996, 277, 923-937).

The oligomeric compounds of the invention may also be conjugated to active drug substances, for example, aspirin, warfarin, phenylbutazone, ibuprofen, suprofen, fenbufen, ketoprofen, (S)-(+)-pranoprofen, carprofen, dansylsarcosine, 2,3,5-triiodobenzoic acid, flufenamic acid, folinic acid, a benzothiadiazide, chlorothiazide, a diazepine, indomethicin, a barbiturate, a cephalosporin, a sulfa drug, an antidiabetic, an antibacterial or an antibiotic. Oligonucleotide-drug conjugates and their preparation are described in U.S. patent application Ser. No. 09/334,130 (filed Jun. 15, 1999) which is incorporated herein by reference in its entirety.

Representative U.S. patents that teach the preparation of such oligonucleotide conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

Oligomeric compounds used in the compositions of the present invention can also be modified to have one or more stabilizing groups that are generally attached to one or both termini of oligomeric compounds to enhance properties such as for example nuclease stability. Included in stabilizing groups are cap structures. By "cap structure or terminal cap moiety" is meant chemical modifications, which have been incorporated at either terminus of oligonucleotides (see for example Wincott et al., WO 97/26270, incorporated by reference herein). These terminal modifications protect the oligomeric compounds having terminal nucleic acid molecules from exonuclease degradation, and can help in delivery and/or localization within a cell. The cap can be present at the 5'-terminus (5'-cap) or at the 3'-terminus (3'-cap) or can be present on both termini. For double-stranded oligomeric compounds, the cap may be present at either or both termini of either strand. In non-limiting examples, the 5'-cap includes inverted abasic residue (moiety), 4',5'-methylene nucleotide; 1-(beta-D-erythrofuranosyl)nucleotide, 4'-thio nucleotide, carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl riucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety (see Wincott et al., International PCT publication No. WO 97/26270, incorporated by reference herein).

Particularly preferred 3'-cap structures of the present invention include, for example 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Tyer, 1993, Tetrahedron 49, 1925; incorporated by reference herein).

Further 3' and 5'-stabilizing groups that can be used to cap one or both ends of an oligomeric compound to impart nuclease stability include those disclosed in WO 03/004602 published on Jan. 16, 2003.

It is not necessary for all positions in an oligomeric compound to be uniformly modified, and in fact more than one of the aforementioned modifications may be incorporated in a single oligomeric compound or even at a single monomeric subunit such as a nucleoside within a oligomeric compound. The present invention also includes oligomeric compounds which are chimeric oligomeric compounds. "Chimeric" oligomeric compounds or "chimeras," in the context of this invention, are oligomeric compounds that contain two or more chemically distinct regions, each made up of at least one monomer unit, i.e., a nucleotide in the case of a nucleic acid based oligomer.

Chimeric oligomeric compounds typically contain at least one region modified so as to confer increased resistance to nuclease degradation, increased cellular uptake, and/or increased binding affinity for the target nucleic acid. An additional region of the oligomeric compound may serve as a substrate for enzymes capable of cleaving RNA:DNA or RNA:RNA hybrids. By way of example, an oligomeric compound may be designed to comprise a region that serves as a substrate for RNase H. RNase H is a cellular endonuclease which cleaves the RNA strand of an RNA:DNA duplex. Activation of RNase H by an oligomeric compound having a cleavage region, therefore, results in cleavage of the RNA target, thereby enhancing the efficiency of the oligomeric compound. Consequently, comparable results can often be obtained with shorter oligomeric compounds having substrate regions when chimeras are used, compared to for example phosphorothioate deoxyoligonucleotides hybridizing to the same target region. Cleavage of the RNA target can be routinely detected by gel electrophoresis and, if necessary, associated nucleic acid hybridization techniques known in the art.

Chimeric oligomeric compounds of the invention may be formed as composite structures of two or more oligonucleotides, oligonucleotide mimics, oligonucleotide analogs, oligonucleosides and/or oligonucleotide mimetics as described above. Such oligomeric compounds have also been referred to in the art as hybrids, hemimers, gapmers or inverted gapmers. Representative U.S. patents that teach the preparation of such hybrid structures include, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference in its entirety.

The conformation of modified nucleosides and their oligomers can be estimated by various methods such as molecular dynamics calculations, nuclear magnetic resonance spectroscopy and CD measurements. Hence, modifications predicted to induce RNA-like conformations (A-form duplex geometry in an oligomeric context), are useful in the oligomeric compounds of the present invention. The synthesis of modified nucleosides amenable to the present invention are known in the art (see for example, Chemistry of Nucleosides and Nucleotides Vol 1-3, ed. Leroy B. Townsend, 1988, Plenum Press.)

In one aspect, the present invention is directed to oligomeric compounds that are designed to have enhanced properties compared to native RNA. One method to design optimized or enhanced oligomeric compounds involves each nucleoside of the selected sequence being scrutinized for possible enhancing modifications. One modification would be the replacement of one or more RNA nucleosides with nucleosides that have the same 3'-endo conformational geometry. Such modifications can enhance chemical and nuclease stability relative to native RNA while at the same time being much cheaper and easier to synthesize and/or incorporate into an oligonucleotide. The sequence can be further divided into regions and the nucleosides of each region evaluated for enhancing modifications that can be the result of a chimeric configuration. Consideration is also given to the 5' and 3'-termini as there are often advantageous modifications that can be made to one or more of the terminal nucleosides. The oligomeric compounds of the present invention may include at least one 5'-modified phosphate group on a single strand or on at least one 5'-position of a double-stranded sequence or sequences. Other modifications considered are internucleoside linkages, conjugate groups, substitute sugars or bases, substitution of one or more nucleosides with nucleoside mimetics and any other modification that can enhance the desired property of the oligomeric compound.

One synthetic 2'-modification that imparts increased nuclease resistance and a very high binding affinity to nucleotides is the 2-methoxyethoxy (2'-MOE, 2'-OCH$_2$CH$_2$OCH$_3$) side chain (Baker et al., J. Biol. Chem., 1997, 272, 11944-12000). One of the immediate advantages of the 2'-MOE substitution is the improvement in binding affinity, which is greater than many similar 2' modifications such as O-methyl, O-propyl, and O-aminopropyl. Oligonucleotides having the 2'-O-methoxyethyl substituent also have been shown to be antisense inhibitors of gene expression with promising features for in vivo use (Martin, P., Helv. Chim. Acta, 1995, 78, 486-504; Altmann et al., Chimia, 1996, 50, 168-176; Altmann et al., Biochem. Soc. Trans., 1996, 24, 630-637; and Altmann et al., Nucleosides Nucleotides, 1997, 16, 917-926). Relative to DNA, the oligonucleotides having the 2'-MOE modification displayed improved RNA affinity and higher nuclease resistance. Chimeric oligonucleotides having 2'-MOE substituents in the wing nucleosides and an internal region of deoxy-phosphorothioate nucleotides (also termed a gapped oligonucleotide or gapmer) have shown effective reduction in the growth of tumors in animal models at low doses. 2'-MOE substituted oligonucleotides have also shown outstanding promise as antisense agents in several disease states. One such MOE substituted oligonucleotide is presently being investigated in clinical trials for the treatment of CMV retinitis.

Unless otherwise defined herein, alkyl means $C_1$-$C_{12}$, $C_1$-$C_8$, or $C_1$-$C_6$, straight or (where possible) branched chain aliphatic hydrocarbyl.

Unless otherwise defined herein, heteroalkyl means $C_1$-$C_{12}$, $C_1$-$C_8$, or $C_1$-$C_6$, straight or (where possible) branched chain aliphatic hydrocarbyl containing at least one, or about 1 to about 3 hetero atoms in the chain, including the terminal portion of the chain. Suitable heteroatoms include N, O and S.

Unless otherwise defined herein, cycloalkyl means $C_3$-$C_{12}$, $C_3$-$C_8$, or $C_3$-$C_6$, aliphatic hydrocarbyl ring.

Unless otherwise defined herein, alkenyl means $C_2$-$C_{12}$, $C_2$-$C_8$, or $C_2$-$C_6$ alkenyl, which may be straight or (where possible) branched hydrocarbyl moiety, which contains at least one carbon-carbon double bond.

Unless otherwise defined herein, alkynyl means $C_2$-$C_{12}$, $C_2$-$C_8$, or $C_2$-$C_6$ alkynyl, which may be straight or (where possible) branched hydrocarbyl moiety, which contains at least one carbon-carbon triple bond.

Unless otherwise defined herein, heterocycloalkyl means a ring moiety containing at least three ring members, at least one of which is carbon, and of which 1, 2 or three ring members are other than carbon. The number of carbon atoms can vary from 1 to about 12, from 1 to about 6, and the total number of ring members varies from three to about 15, or from about 3 to about 8. Suitable ring heteroatoms are N, O and S. Suitable heterocycloalkyl groups include, but are not limited to, morpholino, thiomorpholino, piperidinyl, piperazinyl, homopiperidinyl, homopiperazinyl, homomorpholino, homothiomorpholino, pyrrolodinyl, tetrahydrooxazolyl, tetrahydroimidazolyl, tetrahydrothiazolyl, tetrahydroisoxazolyl, tetrahydropyrrazolyl, furanyl, pyranyl, and tetrahydroisothiazolyl.

Unless otherwise defined herein, aryl means any hydrocarbon ring structure containing at least one aryl ring. Suitable aryl rings have about 6 to about 20 ring carbons. Especially suitable aryl rings include phenyl, napthyl, anthracenyl, and phenanthrenyl.

Unless otherwise defined herein, hetaryl means a ring moiety containing at least one fully unsaturated ring, the ring consisting of carbon and non-carbon atoms. The ring system can contain about 1 to about 4 rings. The number of carbon atoms can vary from 1 to about 12, from 1 to about 6, and the total number of ring members varies from three to about 15, or from about 3 to about 8. Suitable ring heteroatoms are N, O and S. Suitable hetaryl moieties include, but are not limited to, pyrazolyl, thiophenyl, pyridyl, imidazolyl, tetrazolyl, pyridyl, pyrimidinyl, purinyl, quinazolinyl, quinoxalinyl, benzimidazolyl, benzothiophenyl, etc.

Unless otherwise defined herein, where a moiety is defined as a compound moiety, such as hetarylalkyl (hetaryl and alkyl), aralkyl (aryl and alkyl), etc., each of the sub-moieties is as defined herein.

Unless otherwise defined herein, an electron withdrawing group is a group, such as the cyano or isocyanato group that draws electronic charge away from the carbon to which it is attached. Other electron withdrawing groups of note include those whose electronegativities exceed that of carbon, for example halogen, nitro, or phenyl substituted in the ortho- or para-position with one or more cyano, isothiocyanato, nitro or halo groups.

Unless otherwise defined herein, the terms halogen and halo have their ordinary meanings. Suitable halo (halogen) substituents are Cl, Br, and I.

The aforementioned optional substituents are, unless otherwise herein defined, suitable substituents depending upon desired properties. Included are halogens (Cl, Br, I), alkyl, alkenyl, and alkynyl moieties, $NO_2$, $NH_3$ (substituted and unsubstituted), acid moieties (e.g. —$CO_2H$, —$OSO_3H_2$, etc.), heterocycloalkyl moieties, hetaryl moieties, aryl moieties, etc. In all the preceding formulae, the squiggle (~) indicates a bond to an oxygen or sulfur of the 5'-phosphate.

Phosphate protecting groups include those described in U.S. Pat. No. 5,760,209, U.S. Pat. No. 5,614,621, U.S. Pat. No. 6,051,699, U.S. Pat. No. 6,020,475, U.S. Pat. No. 6,326,478, U.S. Pat. No. 6,169,177, U.S. Pat. No. 6,121,437, U.S. Pat. No. 6,465,628 each of which is expressly incorporated herein by reference in its entirety.

Screening methods for the identification of effective modulators of small non-coding RNAs are also comprehended by the instant invention and comprise the steps of contacting a small non-coding RNA, or portion thereof, with one or more candidate modulators, and selecting for one or more candidate modulators which decrease or increase the levels, expression or alter the function of the small non-coding RNA. Once it is shown that the candidate modulator or modulators are capable of modulating (e.g. either decreasing or increasing) the levels, expression or altering the function of the small non-coding RNA, the modulator may then be employed in further investigative studies, or for use as a target validation, research, diagnostic, or therapeutic agent in accordance with the present invention.

Screening methods for the identification of small non-coding RNA mimics are also within the scope of the invention. Screening for small non-coding RNA modulators or mimics can also be performed in vitro, ex vivo, or in vivo by contacting samples, tissues, cells or organisms with candidate modulators or mimics and selecting for one or more candidate modulators which show modulatory effects.

Design and Screening of Duplexed Oligomeric Compounds:

In screening and target validation studies, oligomeric compounds of the invention can be used in combination with their respective complementary strand oligomeric compound to form stabilized double-stranded (duplexed) oligonucleotides. In accordance with the present invention, a series of duplexes comprising the oligomeric compounds of the present invention and their complements can be designed to target a small non-coding RNA. The ends of the strands may be modified by the addition of one or more natural or modified nucleobases to form an overhang. The sense strand of the dsRNA is then designed and synthesized as the complement of the antisense strand and may also contain modifications or additions to either terminus. For example, in some embodiments, both strands of the duplex would be complementary over the central nucleobases, each having overhangs at one or both termini, as described supra.

In some embodiments, a duplex comprising an antisense strand having the sequence CGAGAGGCGGACGGGACCG (SEQ ID NO:2181) may be prepared with blunt ends (no single stranded overhang) as shown:

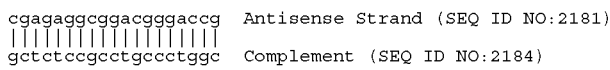

In other embodiments, a duplex comprising an antisense strand having the sequence CGAGAGGCGGACGG-GACCG, having a two-nucleobase overhang of deoxythymidine (dT) and its complement sense strand may be prepared with overhangs as shown:

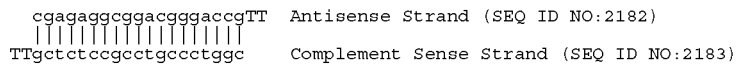

RNA strands of the duplex can be synthesized by methods disclosed herein or purchased from Dharmacon Research Inc., (Lafayette, Colo.).

For use in drug discovery, oligomeric compounds of the present invention are used to elucidate relationships that exist between small non-coding RNAs, genes or proteins and a disease state, phenotype, or condition. These methods include detecting or modulating a target comprising contacting a sample, tissue, cell, or organism with the oligomeric compounds and compositions of the present invention, measuring the levels of the target and/or the levels of downstream gene products including mRNA or proteins encoded thereby, a related phenotypic or chemical endpoint at some time after treatment, and optionally comparing the measured value to an untreated sample, a positive control or a negative control. These methods can also be performed in parallel or in combination with other experiments to determine the function of unknown genes for the process of target validation or to determine the validity of a particular gene product as a target for treatment or prevention of a disease.

The oligomeric compounds and compositions of the present invention can additionally be utilized for diagnostics, therapeutics, prophylaxis and as research reagents and kits. Such uses allows for those of ordinary skill to elucidate the function of particular non-coding or coding nucleic acids or to distinguish between functions of various members of a biological pathway.

For use in kits and diagnostics, the oligomeric compounds and compositions of the present invention, either alone or in combination with other compounds or therapeutics, can be used as tools in differential and/or combinatorial analyses to elucidate expression patterns of a portion or the entire complement of non-coding or coding nucleic acids expressed within cells and tissues.

As one non-limiting example, expression patterns within cells or tissues treated with one or more oligomeric compounds or compositions of the invention are compared to control cells or tissues not treated with the compounds or compositions and the patterns produced are analyzed for differential levels of nucleic acid expression as they pertain, for example, to disease association, signaling pathway, cellular localization, expression level, size, structure or function of the genes examined. These analyses can be performed on stimulated or unstimulated cells and in the presence or absence of other compounds that affect expression patterns.

Cell Culture and Oligonucleotide Treatment:

The effects of oligomeric compounds on target nucleic acid expression or function can be tested in any of a variety of cell types provided that the target nucleic acid is present at measurable levels. This can be readily determined by methods routine in the art, for example Northern blot analysis, ribonuclease protection assays, or real-time RT-PCR. The following cell types are provided for illustrative purposes, but other cell types can be routinely used, provided that the target is present in the cell type chosen.

T-24 Cells:

The human transitional cell bladder carcinoma cell line T-24 is obtained from the American Type Culture Collection (ATCC) (Manassas, Va.). T-24 cells were routinely cultured in complete McCoy's 5A basal media (Invitrogen Corporation, Carlsbad, Calif.) supplemented with 10% fetal calf serum (Invitrogen Corporation, Carlsbad, Calif.), penicillin 100 units per mL, and streptomycin 100 micrograms per mL (Invitrogen Corporation, Carlsbad, Calif.). Cells were routinely passaged by trypsinization and dilution when they reached 90% confluence. For Northern blotting or other analyses, cells harvested when they reached 90% confluence. Cells were seeded into 96-well plates (Falcon-Primaria #353872) at a density of 7000 cells/well for use in real-time RT-PCR analysis.

A549 Cells:

The human lung carcinoma cell line A549 is obtained from the American Type Culture Collection (ATCC) (Manassas, Va.). A549 cells were routinely cultured in DMEM basal media (Invitrogen Corporation, Carlsbad, Calif.) supplemented with 10% fetal calf serum (Invitrogen Corporation, Carlsbad, Calif.), penicillin 100 units per mL, and streptomycin 100 micrograms per mL (Invitrogen Corporation, Carlsbad, Calif.). Cells were routinely passaged by trypsinization and dilution when they reached 90% confluence.

HMECs:

Normal human mammary epithelial cells (HMECs) are obtained from American Type Culture Collection (Manassus, Va.). HMECs are routinely cultured in DMEM high glucose (Invitrogen Life Technologies, Carlsbad, Calif.) supplemented with 10% fetal bovine serum (Invitrogen Life Technologies, Carlsbad, Calif.). Cells are routinely passaged by trypsinization and dilution when they reach approximately 90% confluence. HMECs are plated in 24-well plates (Falcon-Primaria # 353047, BD Biosciences, Bedford, Mass.) at a density of 50,000-60,000 cells per well, and allowed to attach overnight prior to treatment with oligomeric compounds. HMECs are plated in 96-well plates (Falcon-Primaria #353872, BD Biosciences, Bedford, Mass.) at a density of approximately 10,000 cells per well and allowed to attach overnight prior to treatment with oligomeric compounds.

MCF7 Cells:

The breast carcinoma cell line MCF7 is obtained from American Type Culture Collection (Manassus, Va.). MCF7 cells are routinely cultured in DMEM high glucose (Invitrogen Life Technologies, Carlsbad, Calif.) supplemented with 10% fetal bovine serum (Invitrogen Life Technologies, Carlsbad, Calif.). Cells are routinely passaged by trypsinization and dilution when they reach approximately 90% confluence. MCF7 cells are plated in 24-well plates (Falcon-Primaria # 353047, BD Biosciences, Bedford, Mass.) at a density of approximately 140,000 cells per well, and allowed to attach overnight prior to treatment with oligomeric compounds. MCF7 cells are plated in 96-well plates (Falcon-Primaria #353872, BD Biosciences, Bedford, Mass.) at a density of approximately 20,000 cells per well and allowed to attach overnight prior to treatment with oligomeric compounds.

T47D Cells:

The breast carcinoma cell line T47D is obtained from American Type Culture Collection (Manassus, Va.). T47D cells are deficient in expression of the tumor suppressor gene p53. T47D cells are cultured in DMEM high glucose (Invitrogen Life Technologies, Carlsbad, Calif.) supplemented with 10% fetal bovine serum (Invitrogen Life Technologies, Carlsbad, Calif.). Cells are routinely passaged by trypsinization and dilution when they reach approximately 90% confluence. T47D cells are plated in 24-well plates (Falcon-Primaria # 353047, BD Biosciences, Bedford, Mass.) at a density of approximately 170,000 cells per well, and allowed to attach overnight prior to treatment with oligomeric compounds. T47D cells are plated in 96-well plates (Falcon-Primaria #353872, BD Biosciences, Bedford, Mass.) at a density of approximately 20,000 cells per well and allowed to attach overnight prior to treatment with oligomeric compounds.

BJ Cells:

The normal human foreskin fibroblast BJ cell line was obtained from American Type Culture Collection (Manassus, Va.). BJ cells were routinely cultured in MEM high glucose with 2 mM L-glutamine and Earle's BSS adjusted to contain 1.5 g/L sodium bicarbonate and supplemented with 10% fetal bovine serum, 0.1 mM non-essential amino acids and 1.0 mM sodium pyruvate (all media and supplements from Invitrogen Life Technologies, Carlsbad, Calif.). Cells were routinely passaged by trypsinization and dilution when they reached approximately 80% confluence. Cells were plated on collagen-coated 24-well plates (Falcon-Primaria #3047, BD Biosciences, Bedford, Mass.) at approximately 50,000 cells per well, and allowed to attach to wells overnight.

B16-F10 Cells:

The mouse melanoma cell line B 16-F10 was obtained from American Type Culture Collection (Manassas, Va.). B 16-F10 cells were routinely cultured in DMEM high glucose (Invitrogen Life Technologies, Carlsbad, Calif.) supplemented with 10% fetal bovine serum (Invitrogen Life Technologies, Carlsbad, Calif.). Cells were routinely passaged by trypsinization and dilution when they reached approximately 80% confluence. Cells were seeded into collagen-coated 24-well plates (Falcon-Primaria #3047, BD Biosciences, Bedford, Mass.) at approximately 50,000 cells per well and allowed to attach overnight.

HUVECs:

Human vascular endothelial cells (HUVECs) are obtained from American Type Culture Collection (Manassus, Va.). HUVECs are routinely cultured in EBM (Clonetics Corporation, Walkersville, Md.) supplemented with SingleQuots supplements (Clonetics Corporation, Walkersville, Md.). Cells are routinely passaged by trypsinization and dilution when they reach approximately 90% confluence and are maintained for up to 15 passages. HUVECs are plated at approximately 3000 cells/well in 96-well plates (Falcon-Primaria #353872, BD Biosciences, Bedford, Mass.) and treated with oligomeric compounds one day later.

NHDF Cells:

Human neonatal dermal fibroblast (NHDF) cells are obtained from the Clonetics Corporation (Walkersville, Md.). NHDFs were routinely maintained in Fibroblast Growth Medium (Clonetics Corporation, Walkersville, Md.) supplemented as recommended by the supplier. Cells were maintained for up to 10 passages as recommended by the supplier.

HEK Cells:

Human embryonic keratinocytes (HEK) are obtained from the Clonetics Corporation (Walkersville, Md.). HEKs were routinely maintained in Keratinocyte Growth Medium (Clonetics Corporation, Walkersville, Md.) formulated as recommended by the supplier. Cells were routinely maintained for up to 10 passages as recommended by the supplier.

293T Cells:

The human 293T cell line is obtained from American Type Culture Collection (Manassas, Va.). 293T cells are a highly transfectable cell line constitutively expressing the simian virus 40 (SV40) large T antigen. 293T cells were maintained in Dulbeccos' Modified Medium (DMEM) (Invitrogen Corporation, Carlsbad, Calif.) supplemented with 10% fetal calf serum and antibiotics (Life Technologies).

HepG2 Cells:

The human hepatoblastoma cell line HepG2 is obtained from the American Type Culture Collection (ATCC) (Manassas, Va.). HepG2 cells are routinely cultured in Eagle's MEM supplemented with 10% fetal bovine serum, 1 mM non-essential amino acids, and 1 mM sodium pyruvate (medium and all supplements from Invitrogen Life Technologies, Carlsbad, Calif.). Cells are routinely passaged by trypsinization and dilution when they reach approximately 90% confluence. For treatment with oligomeric compounds, cells are seeded into 96-well plates (Falcon-Primaria #353872, BD Biosciences, Bedford, Mass.) at a density of approximately 7000 cells/well prior to treatment with oligomeric compounds. For the caspase assay, cells are seeded into collagen coated 96-well plates (BIOCOAT cellware, Collagen type I, B-D #354407/356407, Becton Dickinson, Bedford, Mass.) at a density of 7500 cells/well.

Preadipocytes:

Human preadipocytes are obtained from Zen-Bio, Inc. (Research Triangle Park, N.C.). Preadipocytes were routinely maintained in Preadipocyte Medium (ZenBio, Inc., Research Triangle Park, N.C.) supplemented with antibiotics as recommended by the supplier. Cells were routinely passaged by trypsinization and dilution when they reached 90% confluence. Cells were routinely maintained for up to 5 passages as recommended by the supplier. To induce differentiation of preadipocytes, cells are then incubated with differentiation media consisting of Preadipocyte Medium further supplemented with 2% more fetal bovine serum (final total of 12%), amino acids, 100 nM insulin, 0.5 mM IBMX, 1 µM dexamethasone and 1 µM BRL49653. Cells are left in differentiation media for 3-5 days and then re-fed with adipocyte media consisting of Preadipocyte Medium supplemented with 33 µM biotin, 17 µM pantothenate, 100 nM insulin and 1 µM dexamethasone. Cells differentiate within one week. At this point cells are ready for treatment with the oligomeric compounds of the invention. One day prior to transfection, 96-well plates (Falcon-Primaria #353872, BD Biosciences, Bedford, Mass.) are seeded with approximately 3000 cells/well prior to treatment with oligomeric compounds.

Differentiated Adipocytes:

Human adipocytes are obtained from Zen-Bio, Inc. (Research Triangle Park, N.C.). Adipocytes were routinely maintained in Adipocyte Medium (ZenBio, Inc., Research Triangle Park, N.C.) supplemented with antibiotics as recommended by the supplier. Cells were routinely passaged by trypsinization and dilution when they reached 90% confluence. Cells were routinely maintained for up to 5 passages as recommended by the supplier.

NT2 Cells:

The NT2 cell line is obtained from the American Type Culture Collection (ATCC; Manassa, Va.). The NT2 cell line, which has the ATCC designation NTERA-2 cl.D1, is a pluripotent human testicular embryonal carcinoma cell line derived by cloning the NTERA-2 cell line. The parental NTERA-2 line was established in 1980 from a nude mouse xenograft of the Tera-2 cell line (ATCC HTB-106). NT2 cells were routinely cultured in DMEM, high glucose (Invitrogen Corporation, Carlsbad, Calif.) supplemented with 10% fetal bovine serum (Invitrogen Corporation, Carlsbad, Calif.). Cells were routinely passaged by trypsinization and dilution when they reached 90% confluence. For Northern blotting or other analyses, cells harvested when they reached 90% confluence.

HeLa Cells:

The human epitheloid carcinoma cell line HeLa is obtained from the American Tissue Type Culture Collection (Manassas, Va.). HeLa cells were routinely cultured in DMEM, high glucose (Invitrogen Corporation, Carlsbad, Calif.) supplemented with 10% fetal bovine serum (Invitrogen Corporation, Carlsbad, Calif.). Cells were routinely passaged by trypsinization and dilution when they reached 90% confluence. For Northern blotting or other analyses, cells were harvested when they reached 90% confluence.

For Northern blotting or other analysis, cells may be seeded onto 100 mm or other standard tissue culture plates and treated similarly, using appropriate volumes of medium and oligonucleotide.

Treatment with Antisense Oligomeric Compounds:

In general, when cells reach approximately 80% confluency, they are treated with oligomeric compounds of the invention. Oligomeric compounds are introduced into cells using the cationic lipid transfection reagent LIPOFECTIN™ (Invitrogen Life Technologies, Carlsbad, Calif.). Oligomeric compounds are mixed with LIPOFECTIN™ in OPTI-MEM™ (Invitrogen Life Technologies, Carlsbad, Calif.) to achieve the desired final concentration of oligomeric compound and LIPOFECTIN™. Before adding to cells, the oligomeric compound, LIPOFECTIN™ and OPTI-MEM™ are mixed thoroughly and incubated for approximately 0.5 hrs. The medium is removed from the plates and the plates are tapped on sterile gauze. Each well of a 96-well plate is washed with 150 µl of phosphate-buffered saline or Hank's balanced salt solution. Each well of a 24-well plate is washed with 250 µL of phosphate-buffered saline or Hank's balanced salt solution. The wash buffer in each well is replaced with 100 µL or 250 µL of the oligomeric compound/OPTI-MEM™/LIPOFECTI™ cocktail for 96-well or 24-well plates, respectively. Untreated control cells receive LIPOFECTIN™ only. The plates are incubated for approximately 4 to 7 hours at 37° C., after which the medium is removed and the plates are tapped on sterile gauze. 100 µl or 1 mL of full growth medium is added to each well of a 96-well plate or a 24-well plate, respectively. Cells are harvested 16-24 hours after oligonucleotide treatment, at which time RNA can be isolated and target reduction measured by real-time RT-PCR, or other phenotypic assays performed. In general, data from treated cells are obtained in triplicate, and results presented as an average of the three trials.

In some embodiments, cells are transiently transfected with oligomeric compounds of the instant invention. In some embodiments, cells are transfected and selected for stable expression of an oligomeric compound of the instant invention.

The concentration of oligonucleotide used varies from cell line to cell line. To determine the optimal oligonucleotide concentration for a particular cell line, the cells are treated with a positive control oligonucleotide at a range of concentrations. For human cells the positive control oligonucleotide may be selected from ISIS 13920 (TCCGTCATCGCTCCT-CAGGG, SEQ ID NO: 1) which is targeted to human H-ras, or ISIS 18078, (GTGCGCGCGAGCCCGAAATC, SEQ ID NO: 2) which is targeted to human Jun-N-terminal kinase-2 (JNK2) or another suitable positive control. Controls are 2'-O-methoxyethyl gapmers (2'-O-methoxyethyls shown in bold) with a phosphorothioate backbone or having chemical modifications similar to the oligonucleotides being tested. For mouse or rat cells the positive control oligonucleotide may be ISIS 15770 (ATGCATTCTGCCCCCAAGGA, SEQ ID NO: 3), a 2'-O-methoxyethyl gapmer (2'-O-methoxyethyls shown in bold) with a phosphorothioate backbone which is targeted to both mouse and rat c-raf. The concentration of positive control oligonucleotide that results in 80% inhibition of c-H-ras (for ISIS 13920), JNK2 (for ISIS 18078) or c-raf (for ISIS 15770) or other suitable control target RNA may then be utilized as the screening concentration for new oligonucleotides in subsequent experiments for that cell line. If 80% inhibition is not achieved, the lowest concentration of positive control oligonucleotide that results in 60% inhibition of target expression or function is then utilized as the oligonucleotide screening concentration in subsequent experiments for that cell line. The concentrations of oligonucleotides used herein can range from 10 nM to 300 nM.

Examples of methods of gene expression analysis known in the art include DNA arrays or microarrays (Brazma and Vilo, FEBS Lett., 2000, 480, 17-24; Celis, et al., FEBS Lett., 2000, 480, 2-16), SAGE (serial analysis of gene expression) (Madden, et al., Drug Discov. Today, 2000, 5, 415-425), READS (restriction enzyme amplification of digested cDNAs) (Prashar and Weissman, Methods Enzymol., 1999, 303, 258-72), TOGA (total gene expression analysis) (Sutcliffe, et al., Proc. Natl. Acad. Sci. U. S. A., 2000, 97, 1976-81), protein arrays and proteomics (Celis, et al., FEBS Lett., 2000, 480, 2-16; Jungblut, et al., Electrophoresis, 1999, 20, 2100-10), expressed sequence tag (EST) sequencing (Celis, et al., FEBS Lett., 2000, 480, 2-16; Larsson, et al., J. Biotechnol., 2000, 80, 143-57), subtractive RNA fingerprinting (SuRF) (Fuchs, et al., Anal. Biochem., 2000, 286, 91-98; Larson, et al., Cytometry, 2000, 41, 203-208), subtractive cloning, differential display (DD) (Jurecic and Belmont, Curr. Opin. Microbiol., 2000, 3, 316-21), comparative genomic hybridization (Carulli, et al., J. Cell Biochem. Suppl., 1998, 31, 286-96), FISH (fluorescent in situ hybridization) techniques (Going and Gusterson, Eur. J. Cancer, 1999, 35, 1895-904), mass spectrometry methods (To, Comb. Chem. High Throughput Screen, 2000, 3, 235-41) and real-time quantitative RT-PCR (Heid, et al., Genome Res., 1996, 6(10), 986-94).

Analysis of Oligonucleotide Inhibition of a Target Levels or Expression:

Modulation of target levels or expression can be assayed in a variety of ways known in the art. For example, target nucleic acid levels can be quantitated by, e.g., Northern blot analysis, competitive polymerase chain reaction (PCR), or real-time quantitative RT-PCR (also known as RT-PCR). Real-time quantitative RT-PCR is presently preferred. RNA analysis can be performed on total cellular RNA or poly(A)+ mRNA. Methods of RNA isolation are well known in the art. Northern blot analysis is also routine in the art. Real-time quantitative RT-PCR can be conveniently accomplished using the commercially available ABI PRISM™ 7600, 7700, or 7900 Sequence Detection System, available from PE-Applied Biosystems, Foster City, Calif. and used according to manufacturer's instructions.

RNA Isolation:

Poly(A)+ mRNA Isolation

Poly(A)+ mRNA was isolated according to Miura et al., (*Clin. Chem.,* 1996, 42, 1758-1764). Other methods for poly (A)+ mRNA isolation are routine in the art. Briefly, for cells grown on 96-well plates, growth medium was removed from the cells and each well was washed with 200 µL cold phosphate-buffered saline (PBS). 60 µL lysis buffer (10 mM Tris-HCl, pH 7.6, 1 mM EDTA, 0.5 M NaCl, 0.5% NP-40, 20 mM vanadyl-ribonucleoside complex) was added to each well, the plate was gently agitated and then incubated at room temperature for five minutes. 55 µL of lysate was transferred to Oligo d(T) coated 96-well plates (AGCT Inc., Irvine Calif.). Plates were incubated for 60 minutes at room temperature, washed 3 times with 200 µL of wash buffer (10 mM Tris-HCl pH 7.6, 1 mM EDTA, 0.3 M NaCl). After the final wash, the plate was blotted on paper towels to remove excess wash buffer and then air-dried for 5 minutes. 60 µL of elution buffer (5 mM Tris-HCl pH 7.6), preheated to 70° C., was added to each well, the plate was incubated on a 90° C. hot plate for 5 minutes, and the eluate was then transferred to a fresh 96-well plate.

Cells grown on 100 mm or other standard plates may be treated similarly, using appropriate volumes of all solutions.

Total RNA Isolation

Total RNA was isolated using an RNEASY 96™ kit and buffers purchased from Qiagen Inc. (Valencia, Calif.) following the manufacturer's recommended procedures. Briefly, for cells grown on 96-well plates, growth medium was removed from the cells and each well was washed with 200 µL cold PBS. 150 µL Buffer RLT was added to each well and the plate vigorously agitated for 20 seconds. 150 µL of 70% ethanol was then added to each well and the contents mixed by pipetting three times up and down. The samples were then transferred to the RNEASY 96™ well plate attached to a QIA-VAC™ manifold fitted with a waste collection tray and attached to a vacuum source. Vacuum was applied for 1 minute. 500 µL of Buffer RW1 was added to each well of the RNEASY 96™ plate and incubated for 15 minutes and the vacuum was again applied for 1 minute. An additional 500 µL of Buffer RW1 was added to each well of the RNEASY 96™ plate and the vacuum was applied for 2 minutes. 1 mL of Buffer RPE was then added to each well of the RNEASY 96™ plate and the vacuum applied for a period of 90 seconds. The Buffer RPE wash was then repeated and the vacuum was applied for an additional 3 minutes. The plate was then removed from the QIAVAC™ manifold and blotted dry on paper towels. The plate was then re-attached to the QIAVAC™ manifold fitted with a collection tube rack containing 1.2 mL collection tubes. RNA was then eluted by pipetting 140 µL of RNAse free water into each well, incubating 1 minute, and then applying the vacuum for 3 minutes.

The repetitive pipetting and elution steps may be automated using a QIAGEN Bio-Robot 9604 (Qiagen, Inc., Valencia Calif.). Essentially, after lysing of the cells on the culture plate, the plate is transferred to the robot deck where the pipetting, DNase treatment and elution steps are carried out.

Real-time Quantitative PCR Analysis of a Target RNA Levels:

Quantitation of a target RNA levels was accomplished by real-time quantitative PCR using the ABI PRISM™ 7600, 7700, or 7900 Sequence Detection System (PE-Applied Biosystems, Foster City, Calif.) according to manufacturer's instructions. This is a closed-tube, non-gel-based, fluorescence detection system which allows high-throughput quantitation of polymerase chain reaction (PCR) products in real-time. As opposed to standard PCR in which amplification products are quantitated after the PCR is completed, products in real-time quantitative PCR are quantitated as they accumulate. This is accomplished by including in the PCR reaction an oligonucleotide probe that anneals specifically between the forward and reverse PCR primers, and contains two fluorescent dyes. A reporter dye (e.g., FAM or JOE, obtained from either PE-Applied Biosystems, Foster City, Calif., Operon Technologies Inc., Alameda, Calif. or Integrated DNA Technologies Inc., Coralville, Iowa) is attached to the 5'end of the probe and a quencher dye (e.g., TAMRA, obtained from either PE-Applied Biosystems, Foster City, Calif., Operon Technologies Inc., Alameda, Calif. or Integrated DNA Technologies Inc., Coralville, Iowa) is attached to the 3' end of the probe. When the probe and dyes are intact, reporter dye emission is quenched by the proximity of the 3' quencher dye. During amplification, annealing of the probe to the target sequence creates a substrate that can be cleaved by the 5'-exonuclease activity of Taq polymerase. During the extension phase of the PCR amplification cycle, cleavage of the probe by Taq polymerase releases the reporter dye from the remainder of the probe (and hence from the quencher moiety) and a sequence-specific fluorescent signal is generated. With each cycle, additional reporter dye molecules are cleaved from their respective probes, and the fluorescence intensity is monitored at regular intervals by laser optics built into the ABI PRISM™ Sequence Detection System. In each assay, a series of parallel reactions containing serial dilutions of RNA from untreated control samples generates a standard curve that is used to quantitate the percent inhibition after oligonucleotide treatment of test samples.

Prior to quantitative PCR analysis, primer/probe sets specific to the target gene (or RNA) being measured are evaluated for their ability to be "multiplexed" with a GAPDH amplification reaction. In multiplexing, both the target gene (or RNA) and the internal standard gene GAPDH are amplified concurrently in a single sample. In this analysis, RNA isolated from untreated cells is serially diluted. Each dilution is amplified in the presence of primer/probe sets specific for GAPDH only, target gene (or RNA) only ("single-plexing"), or both (multiplexing). Following PCR amplification, standard curves of GAPDH and target RNA signal as a function of dilution are generated from both the single-plexed and multiplexed samples. If both the slope and correlation coefficient of the GAPDH and target signals generated from the multiplexed samples fall within 10% of their corresponding values generated from the single-plexed samples, the primer/probe set specific for that target is deemed multiplexable. Other methods of PCR are also known in the art.

PCR reagents were obtained from Invitrogen Corporation, (Carlsbad, Calif.). RT-PCR reactions were carried out by adding 20 µL PCR cocktail (2.5× PCR buffer minus $MgCl_2$, 6.6 mM $MgCl_2$, 375 µM each of dATP, dCTP, dCTP and dGTP, 375 nM each of forward primer and reverse primer, 125 nM of probe, 4 Units RNAse inhibitor, 1.25 Units PLATINUM® Taq, 5 Units MuLV reverse transcriptase, and 2.5× ROX dye) to 96-well plates containing 30 µL total RNA solution (20-200 ng). The RT reaction was carried out by incubation for 30 minutes at 48° C. Following a 10 minute incubation at 95° C. to activate the PLATINUM® Taq, 40 cycles of a two-step PCR protocol were carried out: 95° C. for 15 seconds (denaturation) followed by 60° C. for 1.5 minutes (annealing/extension).

Gene (or RNA) target quantities obtained by real time RT-PCR are normalized using either the expression level of GAPDH, a gene whose expression is constant, or by quantifying total RNA using RiboGreen™ (Molecular Probes, Inc. Eugene, Oreg.). GAPDH expression is quantified by real time RT-PCR, by being run simultaneously with the target, multiplexing, or separately. Total RNA is quantified using RiboGreen™ RNA quantification reagent (Molecular Probes, Inc. Eugene, Oreg.). Methods of RNA quantification by RiboGreen™ are taught in Jones, L. J., et al, (Analytical Biochemistry, 1998, 265, 368-374).

In this assay, 170 µL of RiboGreen™ working reagent (RiboGreen™ reagent diluted 1:350 in 10 mM Tris-HCl, 1 mM EDTA, pH 7.5) is pipetted into a 96-well plate containing 30 µL purified, cellular RNA. The plate is read in a CytoFluor 4000 (PE Applied Biosystems) with excitation at 485 nm and emission at 530 nm.

Probes and primers are designed to hybridize to the target sequence.

Northern Blot Analysis of Target RNA Levels:

Eighteen hours after treatment, cell monolayers were washed twice with cold PBS and lysed in 1 mL RNAZOL™ (TEL-TEST "B" Inc., Friendswood, Tex.). Total RNA was prepared following manufacturer's recommended protocols. Twenty micrograms of total RNA was fractionated by electrophoresis through 1.2% agarose gels containing 1.1% formaldehyde using a MOPS buffer system (AMRESCO, Inc. Solon, Ohio). RNA was transferred from the gel to HYBOND™-N+ nylon membranes (Amersham Pharmacia Biotech, Piscataway, N.J.) by overnight capillary transfer using a Northern/Southern Transfer buffer system (TEL-TEST "B" Inc., Friendswood, Tex.). RNA transfer was confirmed by UV visualization. Membranes were fixed by UV cross-linking using a STRATALINKER™ UV Crosslinker 2400 (Stratagene, Inc, La Jolla, Calif.) and then probed using QUICKHYB™ hybridization solution (Stratagene, La Jolla, Calif.) using manufacturer's recommendations for stringent conditions.

To detect a target, a target specific primer/probe set is prepared for analysis by PCR. To normalize for variations in loading and transfer efficiency, membranes can be stripped and probed for human glyceraldehyde-3-phosphate dehydrogenase (GAPDH) RNA (Clontech, Palo Alto, Calif.).

Hybridized membranes were visualized and quantitated using a PHOSPHORIMAGER™ and IMAGEQUANT™ Software V3.3 (Molecular Dynamics, Sunnyvale, Calif.). Data can be normalized to GAPDH levels in untreated controls.

The compounds and compositions of the invention are useful for research and diagnostics, because these compounds and compositions hybridize to nucleic acids or interfere with the normal function of these nucleic acids. Hybridization of the compounds and compositions of the invention with a nucleic acid can be detected by means known in the art. Such means may include conjugation of an enzyme to the compound or composition, radiolabeling or any other suitable detection means. Kits using such detection means for detecting the level of selected proteins in a sample may also be prepared.

The specificity and sensitivity of compounds and compositions can also be harnessed by those of skill in the art for therapeutic uses. Antisense oligomeric compounds have been employed as therapeutic moieties in the treatment of disease states in animals, including humans. Antisense oligonucleotide drugs, including ribozymes, have been safely and effectively administered to humans and numerous clinical trials are presently underway. It is thus established that oligomeric compounds can be useful therapeutic modalities that can be configured to be useful in treatment regimes for the treatment of cells, tissues and animals, especially humans.

For therapeutics, an animal, preferably a human, suspected of having a disease or disorder presenting conditions that can be treated, ameliorated, or improved by modulating the expression of a selected small non-coding target nucleic acid is treated by administering the compounds and compositions. For example, in one non-limiting embodiment, the methods comprise the step of administering to or contacting the animal, an effective amount of a modulator or mimic to treat, ameliorate or improve the conditions associated with the disease or disorder. The compounds of the present invention effectively modulate the activity or function of the small non-coding RNA target or inhibit the expression or levels of the small non-coding RNA target. In one embodiment, the activity or expression of the target in an animal is inhibited by about 10%. In another embodiment the activity or expression of a target in an animal is inhibited by about 30%. Further, the activity or expression of a target in an animal is inhibited by 50% or more, by 60% or more, by 70% or more, by 80% or more, by 90% or more, or by 95% or more. In another embodiment, the present invention provides for the use of a compound of the invention in the manufacture of a medicament for the treatment of any and all conditions disclosed herein.

The reduction of target levels may be measured in serum, adipose tissue, liver or any other body fluid, tissue or organ of the animal known to contain the small non-coding RNA or its precursor. Further, the cells contained within the fluids, tissues or organs being analyzed contain a nucleic acid molecule of a downstream target regulated or modulated by the small non-coding RNA target itself.

The oligomeric compounds and compositions of the invention can be utilized in pharmaceutical compositions by adding an effective amount of the compound or composition to a suitable pharmaceutically acceptable diluent or carrier. Use of the oligomeric compounds and methods of the invention may also be useful prophylactically.

The oligomeric compounds and compositions of the invention may also be admixed, encapsulated, conjugated or otherwise associated with other molecules, molecule structures or mixtures of compounds, as for example, liposomes, receptor-targeted molecules, oral, rectal, topical or other formulations, for assisting in uptake, distribution and/or absorption. Representative U.S. patents that teach the preparation of such uptake, distribution and/or absorption-assisting formulations include, but are not limited to, U.S. Pat. Nos. 5,108,921; 5,354,844; 5,416,016; 5,459,127; 5,521,291; 5,543,158; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595,756, each of which is herein incorporated by reference.

The oligomeric compounds and compositions of the invention encompass any pharmaceutically acceptable salts, esters, or salts of such esters, or any other compound which, upon administration to an animal, including a human, is capable of providing (directly or indirectly) the biologically active metabolite or residue thereof. Accordingly, for example, the disclosure is also drawn to prodrugs and pharmaceutically acceptable salts of the oligomeric compounds of the invention, pharmaceutically acceptable salts of such prodrugs, and other bioequivalents.

The term "prodrug" indicates a therapeutic agent that is prepared in an inactive form that is converted to an active form (i.e., drug) within the body or cells thereof by the action of endogenous enzymes or other chemicals and/or conditions. In particular, prodrug versions of the oligomeric compounds of the invention can be prepared as SATE ((S-acetyl-2-thioethyl) phosphate) derivatives according to the methods disclosed in WO 93/24510 to Gosselin et al., published Dec. 9, 1993 or in WO 94/26764 and U.S. Pat. No. 5,770,713 to Imbach et al. Larger oligomeric compounds that are processed to supply, as cleavage products, compounds capable of modulating the function or expression of small non-coding RNAs or their downstream targets are also considered prodrugs.

The term "pharmaceutically acceptable salts" refers to physiologically and pharmaceutically acceptable salts of the compounds and compositions of the invention: i.e., salts that retain the desired biological activity of the parent compound and do not impart undesired toxicological effects thereto. Suitable examples include, but are not limited to, sodium and postassium salts. For oligonucleotides, examples of pharmaceutically acceptable salts and their uses are further described in U.S. Pat. No. 6,287,860, which is incorporated herein in its entirety.

The present invention also includes pharmaceutical compositions and formulations that include the oligomeric compounds and compositions of the invention. The pharmaceutical compositions of the present invention may be administered in a number of ways depending upon whether local or systemic treatment is desired and upon the area to be treated. Administration may be topical (including ophthalmic and to mucous membranes including vaginal and rectal delivery), pulmonary, e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion; or intracranial, e.g., intrathecal or intraventricular, administration. Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Oligomeric compounds may be formulated for delivery in vivo in an acceptable dosage form, e.g. as parenteral or non-parenteral formulations. Parenteral formulations include intravenous (IV), subcutaneous (SC), intraperitoneal (IP), intravitreal and intramuscular (IM) formulations, as well as formulations for delivery via pulmonary inhalation, intranasal administration, topical administration, etc. Non-parenteral formulations include formulations for delivery via the alimentary canal, e.g. oral administration, rectal administration, intrajejunal instillation, etc. Rectal administration includes administration as an enema or a suppository. Oral administration includes administration as a capsule, a gel capsule, a pill, an elixir, etc.

In some embodiments, an oligomeric compound can be administered to a subject via an oral route of administration. The subject may be an animal or a human (man). An animal subject may be a mammal, such as a mouse, a rat, a dog, a guinea pig, a monkey, a non-human primate, a cat or a pig. Non-human primates include monkeys and chimpanzees. A suitable animal subject may be an experimental animal, such as a mouse, rat, mouse, a rat, a dog, a monkey, a non-human primate, a cat or a pig.

In some embodiments, the subject may be a human. In certain embodiments, the subject may be a human patient. In certain embodiments, the subject may be in need of modulation of expression of one or more genes as discussed in more detail herein. In some particular embodiments, the subject may be in need of inhibition of expression of one or more genes as discussed in more detail herein. In particular embodiments, the subject may be in need of modulation, i.e. inhibition or enhancement, of a nucleic acid target in order to obtain therapeutic indications discussed in more detail herein.

In some embodiments, non-parenteral (e.g. oral) oligomeric compound formulations according to the present invention result in enhanced bioavailability of the compound. In this context, the term "bioavailability" refers to a measurement of that portion of an administered drug which reaches the circulatory system (e.g. blood, especially blood plasma) when a particular mode of administration is used to deliver the drug. Enhanced bioavailability refers to a particular mode of administration's ability to deliver oligonucleotide to the peripheral blood plasma of a subject relative to another mode of administration. For example, when a non-parenteral mode of administration (e.g. an oral mode) is used to introduce the drug into a subject, the bioavailability for that mode of administration may be compared to a different mode of administration, e.g. an IV mode of administration. In some embodiments, the area under a compound's blood plasma concentration curve ($AUC_o$) after non-parenteral (e.g. oral, rectal, intrajejunal) administration may be divided by the area under the drug's plasma concentration curve after intravenous (i.v.) administration ($AUC_{iv}$) to provide a dimensionless quotient (relative bioavailability, RB) that represents the fraction of compound absorbed via the non-parenteral route as compared to the IV route. A composition's bioavailability is said to be enhanced in comparison to another composition's bioavailability when the first composition's relative bioavailability ($RB_1$) is greater than the second composition's relative bioavailability ($RB_2$).

In general, bioavailability correlates with therapeutic efficacy when a compound's therapeutic efficacy is related to the blood concentration achieved, even if the drug's ultimate site of action is intracellular (van Berge-Henegouwen et al., *Gastroenterol.*, 1977, 73, 300). Bioavailability studies have been used to determine the degree of intestinal absorption of a drug by measuring the change in peripheral blood levels of the drug after an oral dose (DiSanto, Chapter 76 In: *Remington's Pharmaceutical Sciences*, 18th Ed., Gennaro, ed., Mack Publishing Co., Easton, Pa., 1990, pages 1451-1458).

In general, an oral composition's bioavailability is said to be "enhanced" when its relative bioavailability is greater than the bioavailability of a composition substantially consisting of pure oligonucleotide, i.e. oligonucleotide in the absence of a penetration enhancer.

Organ bioavailability refers to the concentration of compound in an organ. Organ bioavailability may be measured in test subjects by a number of means, such as by whole-body radiography. Organ bioavailability may be modified, e.g. enhanced, by one or more modifications to the oligomeric compound, by use of one or more carrier compounds or excipients. In general, an increase in bioavailability will result in an increase in organ bioavailability.

Oral oligomeric compound compositions according to the present invention may comprise one or more "mucosal penetration enhancers," also known as "absorption enhancers" or simply as "penetration enhancers." Accordingly, some embodiments of the invention comprise at least one oligomeric compound in combination with at least one penetration enhancer. In general, a penetration enhancer is a substance that facilitates the transport of a drug across mucous membrane(s) associated with the desired mode of administration, e.g. intestinal epithelial membranes. Accordingly it is desirable to select one or more penetration enhancers that facilitate the uptake of one or more oligomeric compounds, without interfering with the activity of the compounds, and in such a manner the compounds can be introduced into the body of an animal without unacceptable side-effects such as toxicity, irritation or allergic response.

Embodiments of the present invention provide compositions comprising one or more pharmaceutically acceptable penetration enhancers, and methods of using such compositions, which result in the improved bioavailability of oligomeric compounds administered via non-parenteral modes of administration. Heretofore, certain penetration enhancers have been used to improve the bioavailability of certain drugs. See Muranishi, *Crit. Rev. Ther. Drug Carrier Systems,* 1990, 7, 1 and Lee et al., *Crit. Rev. Ther. Drug Carrier Systems,* 1991, 8, 91. It has been found that the uptake and delivery of oligonucleotides can be greatly improved even when administered by non-parenteral means through the use of a number of different classes of penetration enhancers.

In some embodiments, compositions for non-parenteral administration include one or more modifications from naturally-occurring oligonucleotides (i.e. full-phosphodiester deoxyribosyl or full-phosphodiester ribosyl oligonucleotides). Such modifications may increase binding affinity, nuclease stability, cell or tissue permeability, tissue distribution, or other biological or pharmacokinetic property. Modifications may be made to the base, the linker, or the sugar, in general, as discussed in more detail herein with regards to oligonucleotide chemistry. In some embodiments of the invention, compositions for administration to a subject, and in particular oral compositions for administration to an animal or human subject, will comprise modified oligonucleotides having one or more modifications for enhancing affinity, stability, tissue distribution, or other biological property.

Suitable modified linkers include phosphorothioate linkers. In some embodiments according to the invention, the oligomeric compound has at least one phosphorothioate linker. Phosphorothioate linkers provide nuclease stability as well as plasma protein binding characteristics to the compound. Nuclease stability is useful for increasing the in vivo lifetime of oligomeric compounds, while plasma protein binding decreases the rate of first pass clearance of oligomeric compound via renal excretion. In some embodiments according to the present invention, the oligomeric compound has at least two phosphorothioate linkers. In some embodiments, wherein the oligomeric compound has exactly n nucleosides, the oligomeric compound has from one to n−1 phosphorothioate linkages. In some embodiments, wherein the oligomeric compound has exactly n nucleosides, the oligomeric compound has n−1 phosphorothioate linkages. In other embodiments wherein the oligomeric compound has exactly n nucleoside, and n is even, the oligomeric compound has from 1 to n/2 phosphorothioate linkages, or, when n is odd, from 1 to (n−1)/2 phosphorothioate linkages. In some embodiments, the oligomeric compound has alternating phosphodiester (PO) and phosphorothioate (PS) linkages. In other embodiments, the oligomeric compound has at least one stretch of two or more consecutive PO linkages and at least one stretch of two or more PS linkages. In other embodiments, the oligomeric compound has at least two stretches of PO linkages interrupted by at least one PS linkage.

In some embodiments, at least one of the nucleosides is modified on the ribosyl sugar unit by a modification that imparts nuclease stability, binding affinity or some other beneficial biological property to the sugar. In some cases, the sugar modification includes a 2'-modification, e.g. the 2'-OH of the ribosyl sugar is replaced or substituted. Suitable replacements for 2'-OH include 2'-F and 2'-arabino-F. Suitable substitutions for OH include 2'-O-alkyl, e.g. 2'-O-methyl, and 2'-O-substituted alkyl, e.g. 2'-O-methoxyethyl, 2'-O-aminopropyl, etc. In some embodiments, the oligomeric compound contains at least one 2'-modification. In some embodiments, the oligomeric compound contains at least 2 2'-modifications. In some embodiments, the oligomeric compound has at least one 2'-modification at each of the termini (i.e. the 3'- and 5'-terminal nucleosides each have the same or different 2'-modifications). In some embodiments, the oligomeric compound has at least two sequential 2'-modifications at each end of the compound. In some embodiments, oligomeric compounds further comprise at least one deoxynucleoside. In particular embodiments, oligomeric compounds comprise a stretch of deoxynucleosides such that the stretch is capable of activating RNase (e.g. RNase H) cleavage of an RNA to which the oligomeric compound is capable of hybridizing. In some embodiments, a stretch of deoxynucleosides capable of activating RNase-mediated cleavage of RNA comprises about 8 to about 16, e.g. about 8 to about 16 consecutive deoxynucleosides. In further embodiments, oligomeric compounds are capable of eliciting cleaveage by dsRNAse enzymes.

Oral compositions for administration of non-parenteral oligomeric compounds and compositions of the present invention may be formulated in various dosage forms such as, but not limited to, tablets, capsules, liquid syrups, soft gels, suppositories, and enemas. The term "alimentary delivery" encompasses e.g. oral, rectal, endoscopic and sublingual/buccal administration. A common requirement for these modes of administration is absorption over some portion or all of the alimentary tract and a need for efficient mucosal penetration of the nucleic acid(s) so administered.

Delivery of a drug via the oral mucosa, as in the case of buccal and sublingual administration, has several desirable features, including, in many instances, a more rapid rise in plasma concentration of the drug than via oral delivery (Harvey, Chapter 35 *In: Remington's Pharmaceutical Sciences,* 18th Ed., Gennaro, ed., Mack Publishing Co., Easton, Pa., 1990, page 711).

Endoscopy may be used for delivery directly to an interior portion of the alimentary tract. For example, endoscopic retrograde cystopancreatography (ERCP) takes advantage of extended gastroscopy and permits selective access to the biliary tract and the pancreatic duct (Hirahata et al., *Gan To Kagaku Ryoho,* 1992, 19(10 Suppl.), 1591). Pharmaceutical compositions, including liposomal formulations, can be delivered directly into portions of the alimentary canal, such as, e.g., the duodenum (Somogyi et al., *Pharm. Res.,* 1995, 12, 149) or the gastric submucosa (Akamo et al., *Japanese J. Cancer Res.,* 1994, 85, 652) via endoscopic means. Gastric lavage devices (Inoue et al., *Artif. Organs,* 1997, 21, 28) and percutaneous endoscopic feeding devices (Pennington et al., *Ailment Pharmacol. Ther.,* 1995, 9, 471) can also be used for direct alimentary delivery of pharmaceutical compositions.

In some embodiments, oligomeric compound formulations may be administered through the anus into the rectum or lower intestine. Rectal suppositories, retention enemas or rectal catheters can be used for this purpose and may be preferred when patient compliance might otherwise be difficult to achieve (e.g., in pediatric and geriatric applications, or when the patient is vomiting or unconscious). Rectal administration can result in more prompt and higher blood levels than the oral route. (Harvey, Chapter 35 *In: Remington's Pharmaceutical Sciences,* 18th Ed., Gennaro, ed., Mack Publishing Co., Easton, Pa., 1990, page 711). Because about 50% of the drug that is absorbed from the rectum will bypass the liver, administration by this route significantly reduces the potential for first-pass metabolism (Benet et al., Chapter 1 *In: Goodman & Gilman's The Pharmacological Basis of Therapeutics,* 9th Ed., Hardman et al., eds., McGraw-Hill, New York, N.Y., 1996).

Some embodiments of the present invention employ various penetration enhancers in order to effect transport of oligomeric compounds and compositions across mucosal and epithelial membranes. Penetration enhancers may be classified as belonging to one of five broad categories—surfactants, fatty acids, bile salts, chelating agents, and non-chelating non-surfactants (Lee et al., *Critical Reviews in Therapeutic Drug Carrier Systems,* 1991, p. 92). Penetration enhancers and their uses are described in U.S. Pat. No. 6,287,860, which is incorporated herein in its entirety. Accordingly, some embodiments comprise oral oligomeric compound compositions comprising at least one member of the group consisting of surfactants, fatty acids, bile salts, chelating agents, and non-chelating surfactants. Further embodiments comprise oral oligomeric compound comprising at least one fatty acid, e.g. capric or lauric acid, or combinations or salts thereof. Other embodiments comprise methods of enhancing the oral bioavailability of an oligomeric compound, the method comprising co-administering the oligomeric compound and at least one penetration enhancer.

Other excipients that may be added to oral oligomeric compound compositions include surfactants (or "surface-active agents"), which are chemical entities which, when dissolved in an aqueous solution, reduce the surface tension of the solution or the interfacial tension between the aqueous solution and another liquid, with the result that absorption of oligomeric compounds through the alimentary mucosa and other epithelial membranes is enhanced. In addition to bile salts and fatty acids, surfactants include, for example, sodium lauryl sulfate, polyoxyethylene-9-lauryl ether and polyoxyethylene-20-cetyl ether (Lee et al., *Critical Reviews in Therapeutic Drug Carrier Systems,* 1991, page 92); and perfluorohemical emulsions, such as FC-43 (Takahashi et al., *J. Pharm. Phamacol.,* 1988, 40, 252).

Fatty acids and their derivatives which act as penetration enhancers and may be used in compositions of the present invention include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glyceryl 1-monocaprate, 1-dodecylazacycloheptan-2-one, acylcarnitines, acylcholines and mono- and di-glycerides thereof and/or physiologically acceptable salts thereof (i.e., oleate, laurate, caprate, myristate, palmitate, stearate, linoleate, etc.) (Lee et al., *Critical Reviews in Therapeutic Drug Carrier Systems,* 1991, page 92; Muranishi, *Critical Reviews in Therapeutic Drug Carrier Systems,* 1990, 7, 1; El-Hariri et al., *J. Pharm. Pharmacol.,* 1992, 44, 651).

In some embodiments, oligomeric compound compositions for oral delivery comprise at least two discrete phases, which phases may comprise particles, capsules, gel-capsules, microspheres, etc. Each phase may contain one or more oligomeric compounds, penetration enhancers, surfactants, bioadhesives, effervescent agents, or other adjuvant, excipient or diluent. In some embodiments, one phase comprises at least one oligomeric compound and at least one penetration enhancer. In some embodiments, a first phase comprises at least one oligomeric compound and at least one penetration enhancer, while a second phase comprises at least one penetration enhancer. In some embodiments, a first phase comprises at least one oligomeric compound and at least one penetration enhancer, while a second phase comprises at least one penetration enhancer and substantially no oligomeric compound. In some embodiments, at least one phase is compounded with at least one degradation retardant, such as a coating or a matrix, which delays release of the contents of that phase. In some embodiments, a first phase comprises at least one oligomeric compound, at least one penetration enhancer, while a second phase comprises at least one penetration enhancer and a release-retardant. In particular embodiments, an oral oligomeric compound comprises a first phase comprising particles containing an oligomeric compound and a penetration enhancer, and a second phase comprising particles coated with a release-retarding agent and containing penetration enhancer.

A variety of bile salts also function as penetration enhancers to facilitate the uptake and bioavailability of drugs. The physiological roles of bile include the facilitation of dispersion and absorption of lipids and fat-soluble vitamins (Brunton, Chapter 38 *In: Goodman & Gilman's The Pharmacological Basis of Therapeutics,* 9th Ed., Hardman et al., eds., McGraw-Hill, New York, N.Y., 1996, pages 934-935). Various natural bile salts, and their synthetic derivatives, act as penetration enhancers. Thus, the term "bile salt" includes any of the naturally occurring components of bile as well as any of their synthetic derivatives. The bile salts of the invention include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (CDCA, sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., *Critical Reviews in Therapeutic Drug Carrier Systems,* 1991, page 92; Swinyard, Chapter 39 *In: Remington's Pharmaceutical Sciences,* 18th Ed., Gennaro, ed., Mack Publishing Co., Easton, Pa., 1990, pages 782-783; Muranishi, *Critical Reviews in Therapeutic Drug Carrier Systems,* 1990, 7, 1; Yamamoto et al., *J. Pharm. Exp. Ther.,* 1992, 263, 25; Yamashita et al., *J. Pharm. Sci.,* 1990, 79, 579).

In some embodiments, penetration enhancers useful in some embodiments of present invention are mixtures of penetration enhancing compounds. One such penetration enhancer is a mixture of UDCA (and/or CDCA) with capric and/or lauric acids or salts thereof e.g. sodium. Such mixtures are useful for enhancing the delivery of biologically active substances across mucosal membranes, in particular intestinal mucosa. Other penetration enhancer mixtures comprise about 5-95% of bile acid or salt(s) UDCA and/or CDCA with 5-95% capric and/or lauric acid. Particular penetration enhancers are mixtures of the sodium salts of UDCA, capric acid and lauric acid in a ratio of about 1:2:2 respectively. Anther such penetration enhancer is a mixture of capric and lauric acid (or salts thereof) in a 0.01:1 to 1:0.01 ratio (mole basis). In particular embodiments capric acid and lauric acid are present in molar ratios of e.g. about 0.1:1 to about 1:0.1, in particular about 0.5:1 to about 1:0.5.

Other excipients include chelating agents, i.e. compounds that remove metallic ions from solution by forming complexes therewith, with the result that absorption of oligomeric compounds through the alimentary and other mucosa is enhanced. With regard to their use as penetration enhancers in the present invention, chelating agents have the added advantage of also serving as DNase inhibitors, as most characterized DNA nucleases require a divalent metal ion for catalysis and are thus inhibited by chelating agents (Jarrett, *J. Chromatogr.,* 1993, 618, 315). Chelating agents of the invention include, but are not limited to, disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., *Critical Reviews in Therapeutic Drug Carrier Systems,* 1991, page 92; Muranishi, *Critical Reviews in Therapeutic Drug Carrier Systems,* 1990, 7, 1; Buur et al., *J. Control Rel.,* 1990, 14, 43).

As used herein, non-chelating non-surfactant penetration enhancers may be defined as compounds that demonstrate insignificant activity as chelating agents or as surfactants but that nonetheless enhance absorption of oligomeric compounds through the alimentary and other mucosal membranes (Muranishi, *Critical Reviews in Therapeutic Drug Carrier Systems,* 1990, 7, 1). This class of penetration enhancers includes, but is not limited to, unsaturated cyclic ureas, 1-alkyl- and 1-alkenylazacyclo-alkanone derivatives (Lee et al., *Critical Reviews in Therapeutic Drug Carrier Systems,* 1991, page 92); and non-steroidal anti-inflammatory agents such as diclofenac sodium, indomethacin and phenylbutazone (Yamashita et al., *J. Pharm. Pharmacol.,* 1987, 39, 621).

Agents that enhance uptake of oligomeric compounds at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), can be used.

Some oral oligomeric compound compositions also incorporate carrier compounds in the formulation. As used herein, "carrier compound" or "carrier" can refer to a nucleic acid, or analog thereof, which may be inert (i.e., does not possess biological activity per se) or may be necessary for transport, recognition or pathway activation or mediation, or is recognized as a nucleic acid by in vivo processes that reduce the bioavailability of an oligomeric compound having biological activity by, for example, degrading the biologically active oligomeric compound or promoting its removal from circulation. The coadministration of a oligomeric compound and a carrier compound, typically with an excess of the latter substance, can result in a substantial reduction of the amount of oligomeric compound recovered in the liver, kidney or other extracirculatory reservoirs, presumably due to competition between the carrier compound and the oligomeric compound for a common receptor. For example, the recovery of a partially phosphorothioate oligomeric compound in hepatic tissue can be reduced when it is coadministered with polyinosinic acid, dextran sulfate, polycytidic acid or 4-acetamido-4'isothiocyano-stilbene-2,2'-disulfonic acid (Miyao et al., *Antisense Res. Dev.*, 1995, 5, 115; Takakura et al., *Antisense & Nucl. Acid Drug Dev.*, 1996, 6, 177).

A "pharmaceutical carrier" or "excipient" may be a pharmaceutically acceptable solvent, suspending agent or any other pharmacologically inert vehicle for delivering one or more oligomeric compounds to an animal. The excipient may be liquid or solid and is selected, with the planned manner of administration in mind, so as to provide for the desired bulk, consistency, etc., when combined with an oligomeric compound and the other components of a given pharmaceutical composition. Typical pharmaceutical carriers include, but are not limited to, binding agents (e.g., pregelatinised maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, EXPLOTAB); and wetting agents (e.g., sodium lauryl sulphate, etc.).

Oral oligomeric compound compositions may additionally contain other adjunct components conventionally found in pharmaceutical compositions, at their art-established usage levels. Thus, for example, the compositions may contain additional, compatible, pharmaceutically-active materials such as, for example, antipuritics, astringents, local anesthetics or anti-inflammatory agents, or may contain additional materials useful in physically formulating various dosage forms of the composition of present invention, such as dyes, flavoring agents, preservatives, antioxidants, opacifiers, thickening agents and stabilizers. However, such materials, when added, should not unduly interfere with the biological activities of the components of the compositions of the present invention.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The oligomeric compounds and compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Pharmaceutical compositions of the present invention include, but are not limited to, solutions, emulsions, foams and liposome-containing formulations.

Emulsions are typically heterogenous systems of one liquid dispersed in another in the form of droplets usually exceeding 0.1 μm in diameter. Emulsions may contain additional components in addition to the dispersed phases, and the active drug that may be present as a solution in either the aqueous phase, oily phase or itself as a separate phase. Microemulsions are included as an embodiment of the present invention. Emulsions and their uses are well known in the art and are described in U.S. Pat. No. 6,287,860, which is incorporated herein in its entirety.

Formulations of the present invention include liposomal formulations. As used in the present invention, the term "liposome" means a vesicle composed of amphiphilic lipids arranged in a spherical bilayer or bilayers. Liposomes are unilamellar or multilamellar vesicles which have a membrane formed from a lipophilic material and an aqueous interior that contains the composition to be delivered. Cationic liposomes are positively charged liposomes which are believed to interact with negatively charged nucleic acid molecules to form a stable complex. Liposomes that are pH-sensitive or negatively-charged are believed to entrap nucleic acids rather than complex with it. Both cationic and noncationic liposomes have been used to deliver nucleic acids and oligomeric compounds to cells.

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG) moiety. Liposomes and their uses are described in U.S. Pat. No. 6,287,860, which is incorporated herein in its entirety.

The pharmaceutical formulations and compositions of the present invention may also include surfactants. The use of surfactants in drug products, formulations and in emulsions is well known in the art. Surfactants and their uses are described in U.S. Pat. No. 6,287,860, which is incorporated herein in its entirety.

One of skill in the art will recognize that formulations are routinely designed according to their intended use, i.e. route of administration.

Formulations for topical administration include those in which the oligomeric compounds of the invention are in admixture with a topical delivery agent such as lipids, liposomes, fatty acids, fatty acid esters, steroids, chelating agents and surfactants. Lipids and liposomes include neutral (e.g. dioleoylphosphatidyl DOPE ethanolamine, dimyristoylphosphatidyl choline DMPC, distearolyphosphatidyl choline) negative (e.g. dimyristoylphosphatidyl glycerol DMPG) and cationic (e.g. dioleoyltetramethylaminopropyl DOTAP and dioleoylphosphatidyl ethanolamine DOTMA).

For topical or other administration, oligomeric compounds and compositions of the invention may be encapsulated within liposomes or may form complexes thereto, in particular to cationic liposomes. Alternatively, they may be complexed to lipids, in particular to cationic lipids. Topical formulations are described in detail in U.S. patent application Ser. No. 09/315,298 filed on May 20, 1999, which is incorporated herein by reference in its entirety.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Oral formulations are those in which oligomeric compounds of the invention are administered in conjunction with one or more penetration enhancers surfactants and chelators. A particularly suitable combination is the sodium salt of lauric acid, capric acid and UDCA. Penetration enhancers also include polyoxyethylene-9-lauryl ether, polyoxyethylene-20-cetyl ether. Compounds and compositions of the invention may be delivered orally, in granular form including sprayed dried particles, or complexed to form micro or nanoparticles. Certain oral formulations for oligonucleotides and their preparation are described in detail in U.S. applications Ser. No. 09/108,673 (filed Jul. 1, 1998), U.S. Ser. No. 09/315,298 (filed May 20, 1999) and U.S. Application Publication 20030027780, each of which is incorporated herein by reference in their entirety.

Compositions and formulations for parenteral, intrathecal or intraventricular administration may include sterile aqueous solutions that may also contain buffers, diluents and other suitable additives such as, but not limited to, penetration enhancers, carrier compounds and other pharmaceutically acceptable carriers or excipients.

Certain embodiments of the invention provide pharmaceutical compositions containing one or more of the compounds and compositions of the invention and one or more other chemotherapeutic agents that function by a non-antisense mechanism. Examples of such chemotherapeutic agents include but are not limited to cancer chemotherapeutic drugs such as daunorubicin, daunomycin, dactinomycin, doxorubicin, epirubicin, idarubicin, esorubicin, bleomycin, mafosfamide, ifosfamide, cytosine arabinoside, bis-chloroethylnitrosurea, busulfan, mitomycin C, actinomycin D, mithramycin, prednisone, hydroxyprogesterone, testosterone, tamoxifen, dacarbazine, procarbazine, hexamethylmelamine, pentamethylmelamine, mitoxantrone, amsacrine, chlorambucil, methylcyclohexylnitrosurea, nitrogen mustards, melphalan, cyclophosphamide, 6-mercaptopurine, 6-thioguanine, cytarabine, 5-azacytidine, hydroxyurea, deoxycoformycin, 4-hydroxyperoxycyclophosphoramide, 5-fluorouracil (5-FU), 5-fluorodeoxyuridine (5-FUdR), methotrexate (MTX), colchicine, taxol, vincristine, vinblastine, etoposide (VP-16), trimetrexate, irinotecan, topotecan, gemcitabine, teniposide, cisplatin and diethylstilbestrol (DES). When used with the oligomeric compounds of the invention, such chemotherapeutic agents may be used individually (e.g., 5-FU and oligonucleotide), sequentially (e.g., 5-FU and oligonucleotide for a period of time followed by MTX and oligonucleotide), or in combination with one or more other such chemotherapeutic agents (e.g., 5-FU, MTX and oligonucleotide, or 5-FU, radiotherapy and oligonucleotide). Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions of the invention. Combinations of oligomeric compounds and compositions of the invention and other drugs are also within the scope of this invention. Two or more combined compounds such as two oligomeric compounds or one oligomeric compound combined with further compounds may be used together or sequentially.

In another embodiment, compositions of the invention may contain one or more of the compounds and compositions of the invention targeted to a first nucleic acid target and one or more additional oligomeric compounds targeted to a second nucleic acid target. Alternatively, compositions of the invention may contain two or more oligomeric compounds and compositions targeted to different regions, segments or sites of the same target. Two or more combined compounds may be used together or sequentially.

The formulation of therapeutic compounds and compositions of the invention and their subsequent administration (dosing) is believed to be within the skill of those in the art. Dosing is dependent on severity and responsiveness of the disease state to be treated, with the course of treatment lasting from several days to several months, or until a cure is effected or a diminution of the disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual oligomeric compounds, and can generally be estimated based on $EC_{50}$s found to be effective in in vitro and in vivo animal models. In general, dosage is from 0.01 µg to 100 g per kg of body weight, from 0.1 µg to 10 g per kg of body weight, from 1.0 µg to 1 g per kg of body weight, from 10.0 µg to 100 mg per kg of body weight, from 100 µg to 10 mg per kg of body weight, or from 1 mg to 5 mg per kg of body weight, and may be given once or more daily, weekly, monthly or yearly, or even once every 2 to 20 years. Persons of ordinary skill in the art can easily determine repetition rates for dosing based on measured residence times and concentrations of the drug in bodily fluids or tissues. Following successful treatment, it may be desirable to have the patient undergo maintenance therapy to prevent the recurrence of the disease state, wherein the oligomeric compound is administered in maintenance doses, ranging from 0.01 µg to 100 g per kg of body weight, from 0.1 µg to 10 g per kg of body weight, from 1 µg to 1 g per kg of body weight, from 10 µg to 100 mg per kg of body weight, from 100 µg to 10 mg per kg of body weight, or from 100 µg to 1 mg per kg of body weight, once or more daily, to once every 20 years. The effects of treatments with therapeutic compositions can be assessed following collection of tissues or fluids from a patient or subject receiving said treatments. It is known in the art that a biopsy sample can be procured from certain tissues without resulting in detrimental effects to a patient or subject. In certain embodiments, a tissue and its constituent cells comprise, but are not limited to, blood (e.g., hematopoietic cells, such as human hematopoietic progenitor cells, human hematopoietic stem cells, $CD34^+$ cells $CD4^+$ cells), lymphocytes and other blood lineage cells, bone marrow, breast, cervix, colon, esophagus, lymph node, muscle, peripheral blood, oral mucosa and skin. In other embodiments, a fluid and its constituent cells comprise, but are not limited to, blood, urine, semen, synovial fluid, lymphatic fluid and cerebro-spinal fluid. Tissues or fluids procured from patients can be evaluated for expression levels of a target small non-coding RNA, mRNA or protein. Additionally, the mRNA or protein expression levels of other genes known or suspected to be associated with the specific disease state, condition or phenotype can be assessed. mRNA levels can be measured or evaluated by real-time PCR, Northern blot, in situ hybridization or DNA array analysis.

Protein levels of a downstream target modulated or regulated by a small non-coding RNA can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art.

Western Blot Analysis of Protein Levels:

When small non-coding RNAs have effects on expression of downstream genes or proteins encoded by genes, it is advantageous to measure the protein levels of those gene products. To do this, western blot analysis may be employed.

Western blot analysis (immunoblot analysis) is carried out using standard methods. Cells are harvested 16-20 h after oligomeric compound treatment, washed once with PBS, suspended in Laemmli buffer (100 µl/well), boiled for 5 minutes and loaded on a 16% SDS-PAGE gel. Gradient gels (4-20%) may also be used for the separation of proteins, as is known in the art. Gels are typically run for 1.5 hours at 150 V, and transferred to a membrane, such as PVDF, for western blotting. Appropriate primary antibody directed to a target is used, with a radiolabeled or fluorescently labeled secondary antibody directed against the primary antibody species. Bands are visualized using a PHOSPHORIMAGER™ (Molecular Dynamics, Sunnyvale Calif.).

Furthermore, the effects of treatment can be assessed by measuring biomarkers associated with the disease or condition in the aforementioned tissues and fluids, collected from a patient or subject receiving treatment, by routine clinical methods known in the art. These biomarkers include but are not limited to: glucose, cholesterol, lipoproteins, triglycerides, free fatty acids and other markers of glucose and lipid metabolism; liver transaminases, bilirubin, albumin, blood urea nitrogen, creatine and other markers of kidney and liver function; interleukins, tumor necrosis factors, intracellular adhesion molecules, C-reactive protein and other markers of inflammation; testosterone, estrogen and other hormones; tumor markers; vitamins, minerals and electrolytes.

In vitro and in Vivo Assays:

Phenotypic Assays

Once modulators are designed or identified by the methods disclosed herein, the oligomeric compounds are further investigated in one or more phenotypic assays, each having measurable endpoints predictive or suggestive of efficacy in the treatment, amelioration or improvement of physiologic conditions associated with a particular disease state or condition.

Phenotypic assays, kits and reagents for their use are well known to those skilled in the art and are herein used to investigate the role and/or association of a target in health and disease. Representative phenotypic assays, which can be purchased from any one of several commercial vendors, include those for determining cell viability, cytotoxicity, proliferation or cell survival (Molecular Probes, Eugene, Oreg.; PerkinElmer, Boston, Mass.), protein-based assays including enzymatic assays (Panvera, LLC, Madison, Wis.; BD Biosciences, Franklin Lakes, N.J.; Oncogene Research Products, San Diego, Calif.), cell regulation, signal transduction, inflammation, oxidative processes and apoptosis (Assay Designs Inc., Ann Arbor, Mich.), triglyceride accumulation (Sigma-Aldrich, St. Louis, Mo.), angiogenesis assays, tube formation assays, cytokine and hormone assays and metabolic assays (Chemicon International Inc., Temecula, Calif.; Amersham Biosciences, Piscataway, N.J.).

In one non-limiting example, cells determined to be appropriate for a particular phenotypic assay (i.e., MCF7 cells selected for breast cancer studies; adipocytes for obesity studies) are treated with an oligomeric compound identified from the in vitro studies as well as control compounds at optimal concentrations which are determined by the methods described above. At the end of the treatment period, treated and untreated cells are analyzed by one or more methods specific for the assay to determine phenotypic outcomes and endpoints.

Phenotypic endpoints include changes in cell morphology over time or treatment dose as well as changes in levels of cellular components such as proteins, lipids, nucleic acids, hormones, saccharides or metals. Measurements of cellular status which include pH, stage of the cell cycle, intake or excretion of biological indicators by the cell, are also endpoints of interest.

Analysis of the genotype of the cell (measurement of the expression of one or more of the genes of the cell) after treatment is also used as an indicator of the efficacy or potency of the oligomeric compound. Hallmark genes, or those genes suspected to be associated with a specific disease state, condition, or phenotype, are measured in both treated and untreated cells.

Cell Proliferation and Survival Assays:

In some embodiments, cell proliferation and survival assays are used. Cell cycle regulation is the basis for many cancer therapeutic agents. Unregulated cell proliferation is a characteristic of cancer cells, thus most current chemotherapy agents target dividing cells, for example, by blocking the synthesis of new DNA required for cell division. However, cells in healthy tissues are often also affected by agents that modulate cell proliferation.

In some cases, a cell cycle inhibitor will cause apoptosis in cancer cells, but allow normal cells to undergo growth arrest and therefore remain unaffected (Blagosklonny, *Bioessays,* 1999, 21, 704-709; Chen et al., *Cancer Res.,* 1997, 57, 2013-2019; Evan and Littlewood, *Science,* 1998, 281, 1317-1322; Lees and Weinberg, *Proc. Natl. Acad. Sci. USA,* 1999, 96, 4221-4223). An example of sensitization to anti-cancer agents is observed in cells that have reduced or absent expression of the tumor suppressor genes p53 (Bunz et al., *Science,* 1998, 282, 1497-1501; Bunz et al., *J. Clin. Invest.,* 1999, 104, 263-269; Stewart et al., *Cancer Res.,* 1999, 59, 3831-3837; Wahl et al., *Nat. Med.,* 1996, 2, 72-79). However, cancer cells often escape apoptosis (Lowe and Lin, *Carcinogenesis,* 2000, 21, 485-495; Reed, *Cancer J. Sci. Am.,* 1998, 4 Suppl 1, S8-14). Further disruption of cell cycle checkpoints in cancer cells can increase sensitivity to chemotherapy while allowing normal cells to take refuge in G1 and remain unaffected.

Cell Cycle Assay:

A cell cycle assay is employed to identify genes whose modulation affects cell cycle progression. In addition to normal cells, cells lacking functional p53 are utilized to identify genes whose modulation will sensitize p53-deficient cells to anti-cancer agents. Oligomeric compounds of the invention are tested for their effects on the cell cycle in normal human mammary epithelial cells (HMECs) as well as the breast carcinoma cell lines MCF7 and T47D. The latter two cell lines express similar genes but MCF7 cells express the tumor suppressor p53, while T47D cells are deficient in p53. A 20-nucleotide oligomeric compound with a randomized sequence may be used as a negative control, as it does not target modulators of cell cycle progression. An oligomeric compound targeting kinesin-like 1 is known to inhibit cell cycle progression and may be used as a positive control.

Cells are transfected as described herein. Oligomeric compounds are mixed with LIPOFECTIN™ in OPTI-MEM™ to achieve a final concentration of 200 nM of oligomeric compound and 6 µg/mL LIPOFECTIN™. Compounds of the invention and the positive control are tested in triplicate. The negative control is tested in up to six replicate wells. Untreated control cells receive LIPOFECTIN™ only.

Approximately 24, 48 or 72 hours following transfection, routine procedures are used to prepare cells for flow cytometry analysis and cells are stained with propidium iodide to generate a cell cycle profile using a flow cytometer. The cell cycle profile is analyzed with the ModFit program (Verity Software House, Inc., Topsham Me.).

Fragmentation of nuclear DNA is a hallmark of apoptosis and produces an increase in cells with a hypodiploid DNA content, which are categorized as "subG1." An increase in cells in G1 phase is indicative of a cell cycle arrest prior to entry into S phase; an increase in cells in S phase is indicative of cell cycle arrest during DNA synthesis; and an increase in cells in the G2/M phase is indicative of cell cycle arrest just prior to or during mitosis. Cell cycle profiles of cells treated with oligomeric compounds can be normalized to those of untreated control cells, and values above or below 100% are considered to indicate an increase or decrease, respectively, in the proportion of cells in a particular phase of the cell cycle.

Oligomeric compounds that prevent cell cycle progression are candidate therapeutic agents for the treatment of hyperproliferative disorders, such as cancer or inflammation.

Caspase Assay:

Programmed cell death, or apoptosis, is an important aspect of various biological processes, including normal cell turnover, immune system development and embryonic development. Apoptosis involves the activation of caspases, a family of intracellular proteases through which a cascade of events leads to the cleavage of a select set of proteins. The caspase family can be divided into two groups: the initiator caspases, such as caspase-8 and -9, and the executioner caspases, such as caspase-3, -6 and -7, which are activated by the initiator caspases. The caspase family contains at least 14 members, with differing substrate preferences (Thornberry and Lazebnik, *Science*, 1998, 281, 1312-1316). A caspase assay is utilized to identify genes whose modulation causes apoptosis. The chemotherapeutic drugs taxol, cisplatin, etoposide, gemcitabine, camptothecin, aphidicolin and 5-fluorouracil all have been shown to induce apoptosis in a caspase-dependent manner.

In a further embodiment, a caspase assay is employed to identify genes or targets whose modulation affects apoptosis. In addition to normal cells, cells lacking functional p53 are utilized to identify genes or targets whose modulation will sensitize p53-deficient cells to agents that induce apoptosis. Oligomeric compounds of the invention are assayed for their affects on apoptosis in normal HMECs as well as the breast carcinoma cell lines MCF7 and T47D. HMECs and MCF7 cells express p53, whereas T47D cells do not express this tumor suppressor gene. Cells are cultured in 96-well plates with black sides and flat, transparent bottoms (Corning Incorporated, Corning, N.Y.). DMEM medium, with and without phenol red, is obtained from Invitrogen Life Technologies (Carlsbad, Calif.). MEGM medium, with and without phenol red, is obtained from Cambrex Bioscience (Walkersville, Md.). A 20-nucleotide oligomeric compound with a randomized sequence may be used as a negative control, as it does not target modulators of caspase activity. An oligomeric compound targeted to human Jagged2 or human Notch1, both of which are known to induce caspase activity, may be used as a positive control for caspase activation.

Cells are transfected as described herein. Oligomeric componds are mixed with LIPOFECTIN™ in OPTI-MEM™ to achieve a final concentration of 200 nM of oligomeric compound and 6 µg/mL LIPOFECTIN™. Compounds of the invention and the positive controls are tested in triplicate, and the negative control is tested in up to six replicate wells. Untreated control cells receive LIPOFECTIN™ only.

Caspase-3 activity is evaluated with a fluorometric HTS Caspase-3 assay (Catalog #HTS02; EMD Biosciences, San Diego, Calif.) that detects cleavage after aspartate residues in the peptide sequence DEVD. The DEVD substrate is labeled with a fluorescent molecule, which exhibits a blue to green shift in fluorescence upon cleavage by caspase-3. Active caspase-3 in the oligomeric compound-treated cells is measured by this assay according to the manufacturer's instructions. Approximately 48 hours following treatment, 50 µL of assay buffer containing 10 µM dithiothreitol is added to each well, followed by addition 20 µL of the caspase-3 fluorescent substrate conjugate. Fluorescence in wells is immediately detected (excitation/emission 400/505 nm) using a fluorescent plate reader (SpectraMAX GeminiXS, Molecular Devices, Sunnyvale, Calif.). The plate is covered and incubated at 37° C. for an additional three hours, after which the fluorescence is again measured (excitation/emission 400/505 nm). The value at time zero is subtracted from the measurement obtained at 3 hours. The measurement obtained from the untreated control cells is designated as 100% activity. Caspase-3 activity in cells treated with oligomeric compounds is normalized to that in untreated control cells. Values for caspase activity above or below 100% are considered to indicate that the compound has the ability to stimulate or inhibit caspase activity, respectively.

Oligomeric compounds that cause a significant induction in apoptosis are candidate therapeutic agents with applications in the treatment of conditions in which the induction of apoptosis is desirable, for example, in hyperproliferative disorders. Oligomeric compounds that inhibit apoptosis are candidate therapeutic agents with applications in the treatment of conditions where the reduction of apoptosis is useful, for example, in neurodegenerative disorders.

Angiogenesis Assays:

In some embodiments, angiogenesis assays are used. Angiogenesis is the growth of new blood vessels (veins and arteries) by endothelial cells. This process is important in the development of a number of human diseases, and is believed to be particularly important in regulating the growth of solid tumors. Without new vessel formation it is believed that tumors will not grow beyond a few millimeters in size. In addition to their use as anti-cancer agents, inhibitors of angiogenesis have potential for the treatment of diabetic retinopathy, cardiovascular disease, rheumatoid arthritis and psoriasis (Carmeliet and Jain, *Nature*, 2000, 407, 249-257; Freedman and Isner, *J. Mol. Cell. Cardiol.*, 2001, 33, 379-393; Jackson et al., *Faseb J.*, 1997, 11, 457-465; Saaristo et al., *Oncogene*, 2000, 19, 6122-6129; Weber and De Bandt, *Joint Bone Spine*, 2000, 67, 366-383; Yoshida et al., *Histol. Histopathol.*, 1999, 14, 1287-1294).

Expression of Angiogenic Genes as Measure of Angiogenesis:

During the process of angiogenesis, endothelial cells perform several distinct functions, including the degradation of the extracellular matrix (ECM), migration, proliferation and the formation of tube-like structures (Liekens et al., *Biochem. Pharmacol.*, 2001, 61, 253-270). Endothelial cells must regulate the expression of many genes in order to perform the functions necessary for angiogenesis. This gene regulation has been the subject of intense scrutiny, and many genes have been identified as being important for the angiogenic phenotype. Genes highly expressed in angiogenic endothelial cells include integrin β3, endoglin/CD105, TEM5 and MMP-14/MT-MMP1.

Integrin β3 is part of a family of heterodimeric transmembrane receptors that consist of alpha and beta subunits (Brooks et al., *J. Clin. Invest.,* 1995, 96, 1815-1822). Each subunit recognizes a unique set of ECM ligands, thereby allowing cells to transmit angiogenic signals from the extracellular matrix. Integrin β3 is prominently expressed on proliferating vascular endothelial cells, and it plays roles in allowing new blood vessels to form at tumor sites as well as allowing the epithelial cells of breast tumors to spread (Brooks et al., *J. Clin. Invest.,* 1995, 96, 1815-1822; Drake et al., *J. Cell Sci.,* 1995, 108 (Pt 7), 2655-2661). Blockage of integrin β3 with monoclonal antibodies or low molecular weight antagonists inhibits blood vessel formation in a variety of in-vivo models, including tumor angiogenesis and neovascularization during oxygen-induced retinopathy (Brooks et al., *Science,* 1994, 264, 569-571; Brooks et al., *J. Clin. Invest.,* 1995, 96, 1815-1822; Hammes et al., *Nat. Med.,* 1996, 2, 529-533).

Endoglin is a transforming growth factor receptor-associated protein highly expressed on endothelial cells, and present on some leukemia cells and minor subsets of bone marrow cells (Burrows et al., *Clin. Cancer Res.,* 1995, 1, 1623-1634; Haruta and Seon, *Proc. Natl. Acad. Sci. USA,* 1986, 83, 7898-7902). Its expression is upregulated in endothelial cells of angiogenic tissues and is therefore used as a prognostic indicator in various tumors (Burrows et al., *Clin. Cancer Res.,* 1995, 1, 1623-1634). Endoglin functions as an ancillary receptor influencing binding of the transforming growth factor beta (TGF-beta) family of ligands to signaling receptors, thus mediating cell survival (Massague and Chen, *Genes Dev.,* 2000, 14, 627-644).

Tumor endothelial marker 5 (TEM5) is a putative 7-pass transmembrane protein (GPCR) (Carson-Walter et al., *Cancer Res.,* 2001, 61, 6649-6655). The mRNA transcript, designated KIAA1531, encodes one of many tumor endothelium markers (TEMs) that display elevated expression (greater than 10-fold) during tumor angiogenesis (St Croix et al., *Science,* 2000, 289, 1197-1202). TEM5 is coordinately expressed with other TEMs on tumor endothelium in humans and mice.

Matrix metalloproteinase 14 (MMP-14), a membrane-type MMP covalently linked to the cell membrane, is involved in matrix detachment and migration. MMP-14 is thought to promote tumor angiogenesis; antibodies directed against the catalytic domain of MMP-14 block endothelial-cell migration, invasion and capillary tube formation in vitro (Galvez et al., *J. Biol. Chem.,* 2001, 276, 37491-37500). MMP-14 can degrade the fibrin matrix that surrounds newly formed vessels potentially allowing the endothelial cells to invade further into the tumor tissue (Hotary et al., *J. Exp. Med.,* 2002, 195, 295-308). MMP-14 null mice have impaired angiogenesis during development, further demonstrating the role of MMP-14 in angiogenesis (Vu and Werb, *Genes Dev.,* 2000, 14, 2123-2133; Zhou et al., *Proc. Natl. Acad. Sci. USA,* 2000, 97, 4052-4057).

In some embodiments, HUVECs are used to measure the effects of oligomeric compounds of the invention on the activity of endothelial cells stimulated with human vascular endothelial growth factor (VEGF). A 20-nucleotide oligomeric compound with a randomized sequence may be used as a negative control, as it does not target modulators of HUVEC activity.

Cells are transfected as described herein. Oligomeric compounds are mixed with LIPOFECTIN™ in OPTI-MEM™ to achieve a final concentration of 75 nM of oligomeric compound and 2.25 µg/mL LIPOFECTIN™. Compounds of the invention are tested in triplicate, and the negative control is tested in up to six replicate wells. Untreated control cells receive LIPOFECTIN™ only.

Approximately twenty hours after transfection, cells are induced to express angiogenic genes with recombinant VEGF. Total RNA is harvested approximately 52 hours following transfection, and the amount of total RNA from each sample is determined using a Ribogreen Assay (Invitrogen Life Technologies, Carlsbad, Calif.). Real-time RT-PCR is performed on the total RNA using primer/probe sets for four angiogenic hallmark genes described herein: integrin β3, endoglin, TEM5 and MMP14. Expression levels for each gene are normalized to total RNA. Gene expression in cells treated with oligomeric compounds is normalized to that in untreated control cells. A value above or below 100% is considered to indicated an increase or decrease in gene expression, respectively.

Oligomeric compounds resulting in a decrease in the expression of angiogenic hallmark genes are candidate therapeutic agents for the inhibition of angiogenesis where such activity is desired, for example, in the treatment of cancer, diabetic retinopathy, cardiovascular disease, rheumatoid arthritis and psoriasis. Oligomeric compounds that increase the expression of angiogenic hallmark genes are candidate therapeutic agents with applications where the stimulation of angiogenesis is desired, for example, in wound healing. Endothelial tube formation assay as a measure of angiogenesis:

Angiogenesis is stimulated by numerous factors that promote interaction of endothelial cells with each other and with extracellular matrix molecules, resulting in the formation of capillary tubes. This morphogenic process is necessary for the delivery of oxygen to nearby tissues and plays an essential role in embryonic development, wound healing, and tumor growth (Carmeliet and Jain, *Nature,* 2000, 407, 249-257). Moreover, this process can be reproduced in a tissue culture assay that evaluated the formation of tube-like structures by endothelial cells. There are several different variations of the assay that use different matrices, such as collagen I (Kanayasu et al., *Lipids,* 1991, 26, 271-276), Matrigel (Yamagishi et al., *J. Biol. Chem.,* 1997, 272, 8723-8730) and fibrin (Bach et al., *Exp. Cell Res.,* 1998, 238, 324-334), as growth substrates for the cells. In this assay, HUVECs are plated on a matrix derived from the Engelbreth-Holm-Swarm mouse tumor, which is very similar to Matrigel (Kleinman et al., *Biochemistry,* 1986, 25, 312-318; Madri and Pratt, *J. Histochem. Cytochem.,* 1986, 34, 85-91). Untreated HUVECs form tube-like structures when grown on this substrate. Loss of tube formation in vitro has been correlated with the inhibition of angiogenesis in vivo (Carmeliet and Jain, *Nature,* 2000, 407, 249-257; Zhang et al., *Cancer Res.,* 2002, 62, 2034-2042), which supports the use of in vitro tube formation as an endpoint for angiogenesis.

In some embodiments, HUVECs are used to measure the effects of oligomeric compounds of the invention on endothelial tube formation activity. The tube formation assay is performed using an in vitro Angiogenesis Assay Kit (Chemicon International, Temecula, Calif.). A 20-nucleotide oligomeric compound with a randomized sequence may be used as a negative control, as it does not target modulators of endothelial tube formation.

Oligomeric compounds are mixed with LIPOFECTIN™ in OPTI-MEM™ to achieve a final concentration of 75 nM of oligomeric compound and 2.25 µg/mL LIPOFECTIN™. Untreated control cells receive LIPOFECTIN™ only. Compounds of the invention are tested in triplicate, and the negative control is tested in up to six replicates.

Approximately fifty hours after transfection, cells are transferred to 96-well plates coated with ECMatrix™ (Chemicon International). Under these conditions, untreated HUVECs form tube-like structures. After an overnight incubation at 37° C., treated and untreated cells are inspected by light microscopy. Tube formation in cells treated with oligomeric compounds is compared to that in untreated control cells. Individual wells are assigned discrete scores from 1 to 5 depending on the extent of tube formation. A score of 1 refers to a well with no tube formation while a score of 5 is given to wells where all cells are forming an extensive tubular network.

Oligomeric compounds resulting in a decrease in tube formation are candidate therapeutic agents for the inhibition of angiogenesis where such activity is desired, for example, in the treatment of cancer, diabetic retinopathy, cardiovascular disease, rheumatoid arthritis and psoriasis. Oligomeric compounds that promote endothelial tube formation are candidate therapeutic agents with applications where the stimulation of angiogenesis is desired, for example, in wound healing.

Matrix Metalloproteinase Activity:

During angiogenesis, endothelial cells must degrade the extracellular matrix (ECM) and thus secrete matrix metalloproteinases (MMPs) in order to accomplish this degradation. MMPs are a family of zinc-dependent endopeptidases that fall into eight distinct classes: five are secreted and three are membrane-type MMPs (MT-MMPs) (Egeblad and Werb, *J. Cell Science,* 2002, 2, 161-174). MMPs exert their effects by cleaving a diverse group of substrates, which include not only structural components of the extracellular matrix, but also growth-factor-binding proteins, growth-factor pre-cursors, receptor tyrosine-kinases, cell-adhesion molecules and other proteinases (Xu et al., *J. Cell Biol.,* 2002, 154, 1069-1080).

In some embodiments, oligomeric compounds of the invention are evaluated for their effects on MMP activity in the medium above cultured HUVECs. MMP activity is measured using the EnzChek Gelatinase/Collagenase Assay Kit (Molecular Probes, Eugene, Oreg.). In this assay, HUVECs are plated at approximately 4000 cells per well in 96-well plates and transfected one day later. A 20-nucleotide oligomeric compound with a randomized sequence may be used as a negative control, as it does not target modulators of MMP activity. An oligomeric compound targeted to integrin β3 is known to inhibit MMP activity and may be used as a positive control.

Cells are transfected as described herein. Oligomeric compounds are mixed with LIPOFECTIN™ in OPTI-MEM™ to achieve a final concentration of 75 nM of oligomeric compound and 2.25 μg/mL LIPOFECTIN™. Compounds of the invention and the positive control are tested in triplicate, and the negative control is tested in up to six replicates.

Untreated Control Cells Receive LIPOFECTIN™ Only.

Approximately 50 hours after transfection, a p-aminophenylmercuric acetate (APMA, Sigma-Aldrich, St. Louis, Mo.) solution is added to each well of a Corning-Costar 96-well clear bottom plate (VWR International, Brisbane, Calif.). The APMA solution is used to promote cleavage of inactive MMP precursor proteins. Medium above the HUVECs is then transferred to the wells in the 96-well plate. After approximately 30 minutes, the quenched, fluorogenic MMP cleavage substrate is added, and baseline fluorescence is read immediately at 485 nm excitation/530 nm emission. Following an overnight incubation at 37° C. in the dark, plates are read again to determine the amount of fluorescence, which corresponds to MMP activity. Total protein from HUVEC lysates is used to normalize the readings, and MMP activity from cells treated with oligomeric compounds is normalized to that of untreated control cells. MMP activities above or below 100% are considered to indicate a stimulation or inhibition, respectively, of MMP activity.

Oligomeric compounds resulting in a decrease in MMP activity are candidate therapeutic agents for the inhibition of angiogenesis where such activity is desired, for example, in the treatment of cancer, diabetic retinopathy, cardiovascular disease, rheumatoid arthritis and psoriasis. Oligomeric compounds that increase the expression of angiogenic hallmark genes are candidate therapeutic agents with applications in conditions requiring angiogenesis, for example, in wound healing.

Adipocyte Assays:

In some embodiments, adipocytes assays are used. Insulin is an essential signaling molecule throughout the body, but its major target organs are the liver, skeletal muscle and adipose tissue. Insulin is the primary modulator of glucose homeostasis and helps maintain a balance of peripheral glucose utilization and hepatic glucose production. The reduced ability of normal circulating concentrations of insulin to maintain glucose homeostasis manifests in insulin resistance which is often associated with diabetes, central obesity, hypertension, polycystic ovarian syndrome, dyslipidemia and atherosclerosis (Saltiel, *Cell,* 2001, 104, 517-529; Saltiel and Kahn, *Nature,* 2001, 414, 799-806).

Response of Undifferentiated Adipocytes to Insulin:

Insulin promotes the differentiation of preadipocytes into adipocytes. The condition of obesity, which results in increases in fat cell number, occurs even in insulin-resistant states in which glucose transport is impaired due to the antilipolytic effect of insulin. Inhibition of triglyceride breakdown requires much lower insulin concentrations than stimulation of glucose transport, resulting in maintenance or expansion of adipose stores (Kitamura et al., *Mol. Cell. Biol.,* 1999, 19, 6286-6296; Kitamura et al., *Mol. Cell. Biol.,* 1998, 18, 3708-3717).

One of the hallmarks of cellular differentiation is the upregulation of gene expression. During adipocyte differentiation, the gene expression patterns in adipocytes change considerably. Some genes known to be upregulated during adipocyte differentiation include hormone-sensitive lipase (HSL), adipocyte lipid binding protein (aP2), glucose transporter 4 (Glut4), and peroxisome proliferator-activated receptor gamma (PPAR-γ). Insulin signaling is improved by compounds that bind and inactivate PPAR-γ, a key regulator of adipocyte differentiation (Olefsky, *J. Clin. Invest.,* 2000, 106, 467-472). Insulin induces the translocation of GLUT4 to the adipocyte cell surface, where it transports glucose into the cell, an activity necessary for triglyceride synthesis. In all forms of obesity and diabetes, a major factor contributing to the impaired insulin-stimulated glucose transport in adipocytes is the downregulation of GLUT4. Insulin also induces hormone sensitive lipase (HSL), which is the predominant lipase in adipocytes that functions to promote fatty acid synthesis and lipogenesis (Fredrikson et al., *J. Biol. Chem.,* 1981, 256, 6311-6320). Adipocyte fatty acid binding protein (aP2) belongs to a multi-gene family of fatty acid and retinoid transport proteins. aP2 is postulated to serve as a lipid shuttle, solubilizing hydrophobic fatty acids and delivering them to the appropriate metabolic system for utilization (Fu et al., *J. Lipid Res.,* 2000, 41, 2017-2023; Pelton et al., *Biochem. Biophys. Res. Commun.,* 1999, 261, 456-458). Together, these genes play important roles in the uptake of glucose and the metabolism and utilization of fats.

Leptin secretion and an increase in triglyceride content are also well-established markers of adipocyte differentiation. In addition to its role in adipocytes differentiation, leptin also regulates glucose homeostasis through mechanisms (autocrine, paracrine, endocrine and neural) independent of the adipocyte's role in energy storage and release. As adipocytes differentiate, insulin increases triglyceride accumulation by both promoting triglyceride synthesis and inhibiting triglyceride breakdown (Spiegelman and Flier, Cell, 2001, 104, 531-543). As triglyceride accumulation correlates tightly with cell size and cell number, it is an excellent indicator of differentiated adipocytes.

Oligomeric compounds of the invention are tested for their effects on preadipocyte differentiation. A 20-nucleotide oligomeric compound with a randomized sequence may be used as a negative control, as it does not target modulators of adipocyte differentiation. Tumor necrosis factor alpha (TNF-α) is known to inhibit adipocyte differentiation and may be used as a positive control for the inhibition of adipocyte differentiation as evaluated by leptin secretion. For the other adipocyte differentiation markers assayed, an oligomeric compound targeted to PPAR-γ, also known to inhibit adipocyte differentiation, may be used as a positive control.

Cells are transfected as described herein. Oligomeric componds are mixed with LIPOFECTIN™ in OPTI-MEM™ to achieve a final concentration of 250 nM of oligomeric compound and 7.5 μg/mL LIPOFECTIN™. Untreated control cells receive LIPOFECTIN™ only. Compounds of the invention and the positive control are tested in triplicate, and the negative control is tested in up to six replicate wells.

After the cells have reach confluence (approximately three days), they are exposed for an additional three days to differentiation medium (Zen-Bio, Inc., Research Triangle Park, NC) containing a PPAR-γ agonist, IBMX, dexamethasone, and insulin. Cells are then fed adipocyte medium (Zen-Bio, Inc.), which is replaced at 2 or 3 day intervals.

Leptin secretion into the medium in which adipocytes are cultured is measured by protein ELISA. On day nine post-transfection, 96-well plates are coated with a monoclonal antibody to human leptin (R&D Systems, Minneapolis, Minn.) and left at 4° C. overnight. The plates are blocked with bovine serum albumin (BSA), and a dilution of the treated adipoctye medium is incubated in the plate at room temperature for approximately 2 hours. After washing to remove unbound components, a second monoclonal antibody to human leptin (conjugated with biotin) is added. The plate is then incubated with strepavidin-conjugated horse radish peroxidase (HRP) and enzyme levels are determined by incubation with 3, 3', 5, 5'-tetramethlybenzidine, which turns blue when cleaved by HRP. The $OD_{450}$ is read for each well, where the dye absorbance is proportional to the leptin concentration in the cell lysate. Leptin secretion from cells treated with oligomeric compounds is normalized to that from untreated control cells. With respect to leptin secretion, values above or below 100% are considered to indicate that the compound has the ability to stimulate or inhibit leptin secretion, respectively.

The triglyceride accumulation assay measures the synthesis of triglyceride by adipocytes. Triglyceride accumulation is measured using the Infinity™ Triglyceride reagent kit (Sigma-Aldrich, St. Louis, Mo.). On day nine post-transfection, cells are washed and lysed at room temperature, and the triglyceride assay reagent is added. Triglyceride accumulation is measured based on the amount of glycerol liberated from triglycerides by the enzyme lipoprotein lipase. Liberated glycerol is phosphorylated by glycerol kinase, and hydrogen peroxide is generated during the oxidation of glycerol-1-phosphate to dihydroxyacetone phosphate by glycerol phosphate oxidase. Horseradish peroxidase (HRP) uses $H_2O_2$ to oxidize 4-aminoantipyrine and 3,5 dichloro-2-hydroxybenzene sulfonate to produce a red-colored dye. Dye absorbance, which is proportional to the concentration of glycerol, is measured at 515 nm using an UV spectrophotometer. Glycerol concentration is calculated from a standard curve for each assay, and data are normalized to total cellular protein as determined by a Bradford assay (Bio-Rad Laboratories, Hercules, Calif.). Triglyceride accumulation in cells treated with oligomeric compounds is normalized to that in untreated control cells. Values for triglyceride accumulation above or below 100% are considered to indicate that the compound has the ability to stimulate or inhibit triglyceride accumulation, respectively.

Expression of the four hallmark genes, HSL, aP2, Glut4, and PPARγ, is also measured in adipocytes transfected with oligomeric compounds of the invention. Cells are lysed on day nine post-transfection and total RNA is harvested. The amount of total RNA in each sample is determined using a Ribogreen Assay (Invitrogen Life Technologies, Carlsbad, Calif.). Real-time PCR is performed on the total RNA using primer/probe sets for the adipocyte differentiation hallmark genes Glut4, HSL, aP2, and PPAR-γ. Gene expression in cells treated with oligomeric compounds is normalized to that in untreated control cells. With respect to the four adipocyte differentiation hallmark genes, values above or below 100% are considered to indicate that the compound has the ability to stimulate or inhibit adipocyte differentiation, respectively.

Oligomeric compounds that reduce the expression levels of markers of adipocyte differentiation are candidate therapeutic agents with applications in the treatment, attenuation or prevention of obesity, hyperlipidemia, atherosclerosis, atherogenesis, diabetes, hypertension, or other metabolic diseases as well as having potential applications in the maintenance of the pluripotent phenotype of stem or precursor cells. Oligomeric compounds of the invention resulting in a significant increase in leptin secretion are potentially useful for the treatment of obesity.

Response of Liver-Derived Cells to Insulin:

Insulin mediates its effects by suppressing the RNA expression levels of enzymes important for gluconeogenesis and glycogenolysis, and also by controlling the activities of some metabolic enzymes through post-translational mechanisms (Hall and Granner, J. Basic Clin. Physiol. Pharmacol., 1999, 10, 119-133; Moller, Nature, 2001, 414, 821-827; Saltiel and Kahn, Nature, 2001, 414, 799-806). In liver cells, genes involved in regulating glucose metabolism can be identified by monitoring changes in the expression of selective insulin-responsive genes in a cell culture model. However, primary human hepatocytes are difficult to obtain and work with in culture. Therefore, the insulin signaling assay described herein is performed in the hepatocellular carcinoma cell line HepG2, the most widely used cell culture model for hepatocytes. The insulin responsive genes evaluate in this assay are phosphoenolpyruvate carboxykinase (PEPCK), insulin-like growth factor binding protein 1 (IGFBP-1) and follistatin.

IGFBP-1 is one of a family of six secreted proteins that bind insulin-like growth factor (IGF) with high affinity and thereby modulate IGFs action in vivo (Baxter, Am. J. Physiol. Endocrinol. Metab., 2000, 278, E967-976; Lee et al., Proc. Soc. Exp. Biol. Med., 1997, 216, 319-357). IGFBP-1 is characterized by dynamic variability of levels in circulation due to the regulation of its hepatic secretion (Lee et al., Proc. Soc. Exp. Biol. Med., 1997, 216, 319-357). The multi-hormonal regulation of PEPCK and IGFBP-1 are similar. Glucocorticoids and cyclic AMP (cAMP) stimulate transcription of the IGFBP-1 gene expression whereas insulin acts in a dominant manner to suppress both basal and cAMP or glucocorticoid-stimulated IGFBP-1 gene transcription (O'Brien and Granner, *Physiol. Rev.*, 1996, 76, 1109-1161). PEPCK catalyzes the rate-limiting step in gluconeogenesis, and thereby contributes to hepatic glucose output (Hall and Granner, *J. Basic Clin. Physiol. Pharmacol.*, 1999, 10, 119-133; Moller, *Nature*, 2001, 414, 821-827; Saltiel and Kahn, *Nature*, 2001, 414, 799-806). In hepatoma cells, studies have shown that the expression of PEPCK is stimulated by glucocorticoids, glucagon (via cAMP), and retinoic acid. Insulin acts in a dominant manner to suppress these stimulations as well as basal transcription (O'Brien and Granner, *Physiol. Rev.*, 1996, 76, 1109-1161). In HepG2 cells, prolonged serum starvation induces the expression of PEPCK and subsequent insulin stimulation significantly reduces the PEPCK mRNA level.

Follistatin is significantly stimulated by insulin in HepG2 cells. Interestingly, follistatin levels have been shown to be higher in women with polycystic ovary syndrome (PCOS) (Norman et al., *Hum. Reprod.*, 2001, 16, 668-672). PCOS is a metabolic as well as a reproductive disorder, and an important cause of type 2 diabetes mellitus in women. It is often associated with profound insulin resistance and hyperinsulinemia as well as with a defect in insulin secretion (Dunaif, *Endocr. Rev.*, 1997, 18, 774-800; Nestler et al., *Fertil. Steril.*, 2002, 77, 209-215). PCOS is the most common cause of female infertility in the U.S. and affects 5%-10% of women of child-bearing age (Dunaif, *Endocr. Rev.*, 1997, 18, 774-800; Nestler et al., *Fertil. Steril.*, 2002, 77, 209-215).

In some embodiments, HepG2 cells are used to measure the effects of compounds of the invention on hepatic gene expression following insulin stimulation. A 20-nucleotide oligomeric compound with a randomized sequence may be used as a negative control, as it does not target modulators of hepatic gene expression. Insulin at a concentration of 100 nM may be used as a positive control for the stimulation of hepatic gene expression. An oligomeric compound targeted to human forkhead is known to inhibit hepatic gene expression and may be used as a positive control for the inhibition of gene expression in the presence of insulin.

Cells are transfected as described herein. Oligomeric compounds are mixed with LIPOFECTIN™ in OPTI-MEM™ to achieve a final concentration of 100 nM of oligomeric compound and 3 µg/mL LIPOFECTIN™. Untreated control cells receive LIPOFECTIN™ only. Compounds of the invention and the positive controls are tested in triplicate, and the negative control is tested in up to six replicate wells.

Approximately 28 hours after transfection, the cells are subjected to serum starvation for a period of 12 to 16 hours, using serum-free growth medium. Following serum starvation, cells are treated with 1 nM insulin (insulin-treated) or are left untreated (basal conditions) for approximately four hours. At the same time, untreated control cells in both plates are treated with 100 nM insulin to determine the maximal insulin response. Following insulin treatment (forty-eight hours after transfection), total RNA is harvested from all samples, and the amount of total RNA from each sample is determined using a Ribogreen assay (Invitrogen Corporation, Carlsbad, Calif.). Real-time PCR is performed on the total RNA samples using primer/probe sets for three insulin responsive genes: insulin-like growth factor binding protein-1 (IGFBP-1), cytosolic PEPCK (PEPCK-C), and follistatin. Gene expression levels obtained by real-time PCR are normalized for total RNA content in the samples. Gene expression in cells treated with oligomeric compounds is normalized to that from untreated control cells. Values above or below 100% are considered to indicate an increase or decrease in gene expression, respectively.

Oligomeric compounds that interfere with the expression of genes involved in glucose metabolism are candidate therapeutic agents for the treatment of conditions associated with abnormal glucose metabolism, for example, obesity and diabetes.

Inflammation Assays:

In some embodiments, inflammation assays are used. Inflammation assays are designed to identify genes that regulate the activation and effector phases of the adaptive immune response. During the activation phase, T lymphocytes (also known as T-cells) receiving signals from the appropriate antigens undergo clonal expansion, secrete cytokines, and up-regulate their receptors for soluble growth factors, cytokines and co-stimulatory molecules (Cantrell, *Annu. Rev. Immunol.*, 1996, 14, 259-274). These changes drive T-cell differentiation and effector function. Response to cytokines by non-immune effector cells controls the production of inflammatory mediators that can do extensive damage to host tissues. The cells of the adaptive immune systems, their products, as well as their interactions with various enzyme cascades involved in inflammation (e.g., the complement, clotting, fibrinolytic and kinin cascades) all represent potential points for intervention in inflammatory disease.

Dendritic cells treated with oligomeric compounds targeting different genes are used to identify regulators of dendritic cell-mediated T-cell co-stimulation. The level of interleukin-2 (IL-2) production by T-cells, a critical consequence of T-cell activation (DeSilva et al., *J Immunol.*, 1991, 147, 3261-3267; Salomon and Bluestone, *Annu. Rev. Immunol.*, 2001, 19, 225-252), is used as an endpoint for T-cell activation. T lymphocytes are important immunoregulatory cells that mediate pathological inflammatory responses. Optimal activation of T lymphocytes requires both primary antigen recognition events as well as secondary or co-stimulatory signals from antigen presenting cells (APC). Dendritic cells are the most efficient APCs known and are principally responsible for antigen presentation to T-cells, expression of high levels of co-stimulatory molecules during infection and disease, and the induction and maintenance of immunological memory (Banchereau and Steinman, *Nature*, 1998, 392, 245-252). While a number of co-stimulatory ligand-receptor pairs have been shown to influence T-cell activation, a principal signal is delivered by engagement of CD28 on T-cells by CD80 (B7-1) and CD86 (B7-2) on APCs (Boussiotis et al., *Curr. Opin. Immunol.*, 1994, 6, 797-807; Lenschow et al., *Annu. Rev. Immunol.*, 1996, 14, 233-258). In contrast, a B7 counter-receptor, CTLA-4, has been shown to negatively regulate T-cell activation, maintain immunological homeostasis and promote immune tolerance (Walunas and Bluestone, *J. Immunol.*, 1998, 160, 3855-3860). Inhibition of T-cell co-stimulation by APCs holds promise for novel and more specific strategies of immune suppression. In addition, blocking co-stimulatory signals may lead to the development of long-term immunological anergy (unresponsiveness or tolerance) that would offer utility for promoting transplantation or dampening autoimmunity. T-cell anergy is the direct consequence of failure of T-cells to produce the growth factor interleukin-2 (DeSilva et al., *J. Immunol.*, 1991, 147, 3261-3267; Salomon and Bluestone, *Annu. Rev. Immunol.*, 2001, 19, 225-252). Dendritic cell cytokine production as a measure of the activation phase of the immune response:

In some embodiments, the effects of the oligomeric compounds of the invention are examined on the dendritic cell-mediated costimulation of T-cells. A 20-nucleotide oligomeric compound with a randomized sequence may be used as a negative control, as it does not target modulators of dendritic cell-mediated T-cell costimulation. An oligomeric compound targeted to human CD86 is known to inhibit dendritic cell-mediated T-cell stimulation and may be used as a positive control.

Cells are transfected as described herein. Oligomeric compounds are mixed with LIPOFECTIN™ in OPTI-MEM™ to achieve a final concentration of 200 nM of oligomeric compound and 6 µg/mL LIPOFECTIN™. Untreated control cells receive LIPOFECTIN™ only. Compounds of the invention and the positive control are tested in triplicate, and the negative control is tested in up to six replicates. Following incubation with the oligomeric compounds and LIPOFECTIN™, fresh growth medium with cytokines is added and DC culture is continued for an additional 48 hours. DCs are then co-cultured with Jurkat T-cells in RPMI medium (Invitrogen Life Technologies, Carlsbad, Calif.) supplemented with 10% heat-inactivated fetal bovine serum (Sigma Chemical Company, St. Louis, Mo.). Culture supernatants are collected 24 hours later and assayed for IL-2 levels (IL-2 DuoSet, R&D Systems, Minneapolis, Minn.). IL-2 levels in cells treated with oligomeric compounds are normalized to those from untreated control cells. A value greater than 100% indicates an induction of the inflammatory response, whereas a value less than 100% demonstrates a reduction in the inflammatory response.

Oligomeric compounds that inhibit T-cell co-stimulation are candidate therapeutic compounds with applications in the prevention, treatment or attenuation of conditions associated with hyperstimulation of the immune system, including rheumatoid arthritis, irritable bowel disease, asthma, lupus and multiple sclerosis. Oligomeric compounds that induce T-cell co-stimulation are candidate therapeutic agents for the treatment of immunodeficient conditions.

Cytokine Signaling as a Measure of the Effector Phase of the Inflammatory Response:

The cytokine signaling assay further identifies genes that regulate inflammatory responses of non-immune effector cells (initially endothelial cells) to stimulation with cytokines such as interferon-gamma (IFN-γ). Response to IFN-γ is assessed by measuring the expression levels of three genes: intercellular adhesion molecule-1 (ICAM-1), interferon regulatory factor 1 (IRF 1) and small inducible cytokine subfamily B (Cys-X-Cys), member 11 (SCYB11). The cytokine signaling assay further identifies genes that regulate inflammatory responses of non-immune effector cells (initially endothelial cells) to stimulation with IL-1β or TNF-α (Heyninck et al., J Cell Biol, 1999, 145, 1471-1482; Zetoune et al., Cytokine, 2001, 15, 282-298). Response to IL-1β or TNF-α stimulation is monitored by measuring the expression levels of four genes: A20, intracellular adhesion molecule 1 (ICAM-1), interleukin-9 (IL-8) and macrophage-inflammatory protein 2 (MIP2α). As described below, all of these genes regulate numerous parameters of the inflammatory response.

ICAM-1 is an adhesion molecule expressed at low levels on resting endothelial cells that is markedly up-regulated in response to inflammatory mediators like tumor necrosis factor-α (TNF-α), interleukin-1β (IL-1β) and interferon-γ (IFN-γ) (Springer, Nature, 1990, 346, 425-434). ICAM-1 expression serves to attract circulating leukocytes into the inflammatory site.

IRF-1 binds to upstream cis-regulatory elements of interferon-inducible genes and functions as a transcriptional activator. IRF-1 directly binds to a functional IFN-γ-stimulated response element in the cathepsin S promoter and mediates IFN-γ dependent transcriptional activation (Storm van's Gravesande et al., J Immunol, 2002, 168, 4488-4494).

SCYB11 is essential for mediating normal leukocyte recruitment and trafficking during inflammation. SCYB11 induces a chemotactic response in IL-2 activated T-cells, monocytes and granulocytes (Mohan et al., J Immunol, 2002, 168, 6420-6428).

A20 is a zinc-finger protein that limits the transcription of pro-inflammatory genes by blocking TRAF2-stimulated NK-κB signaling. Studies in mice show that TNF-α dramatically increases A20 expression in mice, and that A20 expression is crucial for their survival (Lee et al., Science, 2000, 289, 2350-2354).

IL-8 is a member of the chemokine gene superfamily, members of which promote the pro-inflammatory phenotype of macrophages, vascular smooth muscle cells and endothelial cells (Koch et al., Science, 1992, 258, 1798-1801). IL-8 has been known as one of the major inducible chemokines with the ability to attract neutrophils to the site of inflammation. More recently, IL-8 has been implicated as a major mediator of acute neutrophil-mediated inflammation, and is therefore a potential anti-inflammatory target (Mukaida et al., Cytokine Growth Factor Rev, 1998, 9, 9-23).

MIP2α, another chemokine known to play a central role in leukocyte extravasation, has more recently been shown to be involved in acute inflammation (Lukacs et al., Chem Immunol, 1999, 72, 102-120). MIP2α is expressed in response to microbial infection, to injection of lipopolysaccharides (LPS), and to stimulation of cells with pro-inflammatory mediators such as IL-1β and TNF-α (Kopydlowski et al., J Immunol, 1999, 163, 1537-1544). Endothelial cells are one of several cell types that are sources of MIP2α (Rudner et al., J Immunol, 2000, 164, 6576-6582).

In some embodiments, the effects of the oligomeric compounds of the invention on the cellular response to cytokines may be examined in HUVECs. A 20-nucleotide oligomeric compound with a randomized sequence may be used as a negative control, as it does not target modulators of cytokine signaling.

Cells are transfected as described herein. Oligomeric compounds are mixed with LIPOFECTIN™ in OPTI-MEM™ to achieve a final concentration of 75 nM of oligomeric compound and 2.25 µg/mL LIPOFECTIN™. Untreated control cells receive LIPOFECTIN™ only. Compounds of the invention are tested in triplicate, and the negative control is tested in up to six replicate wells.

For IFN-γ stimulation, following transfection, fresh growth medium is added and DC culture is continued for an additional 44 hours, after which HUVECS are stimulated with 10 ng/ml of IFN-γ for a period of 4 hours. For stimulation with IL-1β or TNF-α, fresh growth medium is added and DC culture is continued for an additional 46 hours, after which HUVECs are stimulated with 0.1 ng/mL of IL-1β, or 1 ng/mL of TNF-α for a period of 2 hours. Total RNA is harvested 48 hours following transfection, and real time PCR is performed using primer/probe sets to detect ICAM-1, IRF-1 and SCYB11 in IFN-γ-stimulated cells, or ICAM-1, A20, IL-8 and MIP2α in IL-1β-stimulated and TNF-α-stimulted cells. Expression levels of each gene are normalized to total RNA. Gene expression levels from cells treated with oligomeric compounds are normalized to those from untreated control cells. A value greater than 100% indicates an induction of the inflammatory response, whereas a value less than 100% demonstrates a reduction in the inflammatory response.

Oligomeric compounds that inhibit the inflammatory response are candidate therapeutic compounds with applications in the prevention, treatment or attenuation of conditions associated with hyperstimulation of the immune system, including rheumatoid arthritis, irritable bowel disease, asthma, lupus and multiple sclerosis.

In Vivo Studies

The individual subjects of the in vivo studies described herein are warm-blooded vertebrate animals, which includes humans.

Mouse Model of Tumorigenesis:

Animal models of tumorigenesis are used in some embodiments of the present invention. In this model, tumorigenic cells are injected into immunocompromised mice (i.e. nude mice), and subsequent growth of a tumor is measured.

Serially transplanted MDA-MB-231 (a human breast carcinoma cell line, American Type Culture Collection, Manassus, Va.) tumors are established subcutaneously in nude mice. Beginning two weeks later, one or more of the oligomeric compounds of the invention are administered intravenously daily for 14 days at dosages of 15 mg/kg or 30 mg/kg. Control compounds are also administered at these doses, and a saline control is also given. Tumor growth rates are monitored for the two-week period of oligonucleotide administration. Activity of the oligomeric compounds of the invention is measured by a reduction in tumor growth. Activity is measured by reduced tumor volume compared to saline or control compound. Following death or sacrifice of mice, tumor tissue is fixed in 4% formalin, embedded in paraffin, sectioned and stained with hematoxylin and eosin. Tumor tissue sections are evaluated for tumor morphology and size.

Human A549 lung tumor cells are also injected into nude mouse to produce tumors. 200 µl of A549 cells ($5 \times 10^6$ cells) are implanted subcutaneously in the inner thigh of nude mice. Oligomeric compounds of the invention are administered twice weekly for four weeks, beginning one week following tumor cell inoculation. Oligomeric compounds are formulated with cationic lipids (LIPOFECTIN™, Invitrogen Corporation, Carlsbad, Calif.) and given subcutaneously in the vicinity of the tumor. Oligomeric compound dosage is 5 mg/kg with 60 mg/kg cationic lipid. Tumor size is recorded weekly. Activity of the oligomeric compounds of the invention is measured by reduction in tumor size compared to controls.

Xenograft studies are also performed using the U-87 human glioblastoma cell line (American Type Culture Collection, Manassus, Va.). Nude mice are injected subcutaneously with $2 \times 10^7$ U-87 cells. Mice are injected intraperitoneally with one or more of the oligomeric compounds of the invention or a control compound at dosages of either 15 mg/kg or 30 mg/kg for 21 consecutive days beginning 7 days after xenografts are implanted. Saline-injected animals serve as a control. Tumor volumes are measured on days 14, 21, 24, 31 and 35. Activity is measured by reduced tumor volume compared to saline or control compound. Following death or sacrifice of mice, tumor tissue is fixed in 4% formalin, embedded in paraffin, sectioned and stained with hematoxylin and eosin. Tumor tissue sections are evaluated for tumor morphology and size.

Alternatively, intracerebral U-87 xenografts are generated by implanting U-87 glioblastoma cells into the brains of nude mice. Mice are treated via continuous intraperitoneal administration with one or more of the oligomeric compounds of the invention at 20 mg/kg, control compound at 20 mg/kg or saline beginning on day 7 after xenograft implantation. Activity of the oligomeric compounds of the invention is measured by an increase in survival time compared to controls. Following death or sacrifice, brain tissue is fixed in 4% formalin, embedded in paraffin, sectioned and stained with hematoxylin and eosin. Brain tissue sections are evaluated for tumor growth.

Leptin-Deficient Mice (a Model of Obesity and Diabetes (ob/ob Mice)):

Leptin is a hormone produced by fat cells that regulates appetite. Deficiencies in this hormone in both humans and non-human animals leads to obesity. ob/ob mice have a mutation in the leptin gene which results in obesity and hyperglycemia. As such, these mice are a useful model for the investigation of obesity and diabetes and treatments designed to treat these conditions. ob/ob mice have higher circulating levels of insulin and are less hyperglycemic than db/db mice, which harbor a mutation in the leptin receptor. In accordance with the present invention, the oligomeric compounds of the invention are tested in the ob/ob model of obesity and diabetes.

Seven-week old male C57B1/6J-Lep ob/ob mice (Jackson Laboratory, Bar Harbor, Me.) are fed a diet with a fat content of 10-15% and are subcutaneously injected with the oligomeric compounds of the invention or a control compound at a dose of 25 mg/kg two times per week for 4 weeks. Saline-injected animals, leptin wildtype littermates (i.e. lean littermates) and ob/ob mice fed a standard rodent diet serve as controls. After the treatment period, mice are sacrificed and target levels are evaluated in liver, brown adipose tissue (BAT) and white adipose tissue (WAT). RNA isolation and target RNA expression level quantitation are performed as described by other examples herein.

To assess the physiological effects resulting from modulation of target, the ob/ob mice are evaluated at the end of the treatment period for serum lipids, serum free fatty acids, serum cholesterol (CHOL), liver triglycerides, fat tissue triglycerides and liver enzyme levels. Hepatic steatosis, or clearing of lipids from the liver, is assessed by measuring the liver triglyceride content. Hepatic steatosis is assessed by routine histological analysis of frozen liver tissue sections stained with oil red O stain, which is commonly used to visualize lipid deposits, and counterstained with hematoxylin and eosin, to visualize nuclei and cytoplasm, respectively.

The effects of target modulation on glucose and insulin metabolism are evaluated in the ob/ob mice treated with the oligomeric compounds of the invention. Plasma glucose is measured at the start of the treatment and after 2 weeks and 4 weeks of treatment. Plasma insulin is similarly measured at the beginning of the treatment, and following at 2 weeks and at 4 weeks of treatment. Glucose and insulin tolerance tests are also administered in fed and fasted mice. Mice receive intraperitoneal injections of either glucose or insulin, and the blood glucose and insulin levels are measured before the insulin or glucose challenge and at 15, 20 or 30 minute intervals for up to 3 hours.

To assess the metabolic rate of ob/ob mice treated with the oligomeric compounds of the invention, the respiratory quotient and oxygen consumption of the mice are also measured.

The ob/ob mice that receive treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism. These genes include, but are not limited to, HMG-CoA reductase, acetyl-CoA carboxylase 1 and acetyl-CoA carboxylase 2, carnitine palmitoyltransferase I and glycogen phosphorylase, glucose-6-phosphatase and phosphoenolpyruvate carboxykinase 1, lipoprotein lipase and hormone sensitive lipase. mRNA levels in liver and white and brown adipose tissue are quantitated by real-time PCR as described in other examples herein, employing primer/probe sets that are generated using published sequences of each gene of interest.

Leptin Receptor-Deficient Mice (a Model of Obesity and Diabetes (db/db Mice)):

db/db mice have a mutation in the leptin receptor gene which results in obesity and hyperglycemia. As such, these mice are a useful model for the investigation of obesity and diabetes and treatments designed to treat these conditions. db/db mice, which have lower circulating levels of insulin and are more hyperglycemic than ob/ob mice which harbor a mutation in the leptin gene, are often used as a rodent model of type 2 diabetes. In accordance with the present invention, oligomeric compounds of the present invention are tested in the db/db model of obesity and diabetes.

Seven-week old male C57B1/6J-Lepr db/db mice (Jackson Laboratory, Bar Harbor, Me.) are fed a diet with a fat content of 15-20% and are subcutaneously injected with one or more of the oligomeric compounds of the invention or a control compound at a dose of 25 mg/kg two times per week for 4 weeks. Saline-injected animals, leptin receptor wildtype littermates (i.e. lean littermates) and db/db mice fed a standard rodent diet serve as controls. After the treatment period, mice are sacrificed and target levels are evaluated in liver, BAT and WAT as described supra.

To assess the physiological effects resulting from modulation of target, the db/db mice that receive treatment are evaluated at the end of the treatment period for serum lipids, serum free fatty acids, serum cholesterol (CHOL), liver triglycerides, fat tissue triglycerides and liver enzyme levels. Hepatic steatosis is assessed by measuring the liver triglyceride content and oil red O staining, as described supra.

The effects of target modulation on glucose and insulin metabolism are also evaluated in the db/db mice treated with the oligomeric compounds of the invention. Plasma glucose is measured at the start of the treatment and after 2 weeks and 4 weeks of treatment. Plasma insulin is similarly measured at the beginning of the treatment, and following 2 weeks and 4 weeks of treatment. Glucose and insulin tolerance tests are also administered in fed and fasted mice. Mice receive intraperitoneal injections of either glucose or insulin, and the blood glucose levels are measured before the insulin or glucose challenge and 15, 30, 60, 90 and 120 minutes following the injection.

To assess the metabolic rate of db/db mice treated with the oligomeric compounds of the invention, the respiratory quotient and oxygen consumption of the mice is also measured.

The db/db mice that receive treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism, as described supra.

Lean Mice on a Standard Rodent Diet:

C57B1/6 mice are maintained on a standard rodent diet and are used as control (lean) animals. In one embodiment of the present invention, the oligomeric compounds of the invention are tested in normal, lean animals.

Seven-week old male C57B1/6 mice are fed a diet with a fat content of 4% and are subcutaneously injected with one or more of the oligomeric compounds of the invention or control compounds at a dose of 25 mg/kg two times per week for 4 weeks. Saline-injected animals serve as a control. After the treatment period, mice are sacrificed and target levels are evaluated in liver, BAT and WAT as described supra.

To assess the physiological effects resulting from modulation of the target, the lean mice that receive treatment are evaluated at the end of the treatment period for serum lipids, serum free fatty acids, serum cholesterol (CHOL), liver triglycerides, fat tissue triglycerides and liver enzyme levels. Hepatic steatosis is assessed by measuring the liver triglyceride content and oil red O staining, as described supra.

The effects of target modulation on glucose and insulin metabolism are also evaluated in the lean mice treated with the oligomeric compounds of the invention. Plasma glucose is measured at the start of the treatment and after 2 weeks and 4 weeks of treatment. Plasma insulin is similarly measured at the beginning of the treatment, and following 2 weeks and 4 weeks of treatment. Glucose and insulin tolerance tests are also administered in fed and fasted mice. Mice receive intraperitoneal injections of either glucose or insulin, and the blood glucose levels are measured before the insulin or glucose challenge and 15, 30, 60, 90 and 120 minutes following the injection.

To assess the metabolic rate of lean mice treated with the oligomeric compounds of the invention, the respiratory quotient and oxygen consumption of the mice is also measured.

The lean mice that received treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism, as described supra.

Levin Model of Diet-Induced Obesity in Rats:

The Levin Model is a polygenic model of rats selectively bred to develop diet-induced obesity (DIO) associated with impaired glucose tolerance, dyslipidemia and insulin resistance when fed a high-fat diet (Levin, et al., Am. J. Physiol, 1997, 273, R725-30). The advantage of this model is that it displays traits more similar to human obesity and glucose intolerance than in animals that are obese/hyperinsulinemic due to genetic defects e.g. defects in leptin signaling. This model is useful in investigating the oligomeric compounds of the present invention for their ability to affect obesity and related complications, such as impaired glucose tolerance, dyslipidemia and insulin resistance. In accordance with the present invention, the oligomeric compounds of the invention are tested in the Levin model of diet-induced obesity.

Eight-week old male Levin rats (Charles River Laboratories, Wilmington, Mass.), weighing ~500 g, are fed a diet with a fat content of 60% for eight weeks, after which they are subcutaneously injected with one or more of the oligomeric compounds of the invention at a dose of 25 mg/kg×2 per week for 8 weeks. Control groups consist of animals injected with saline or a control compound and lean littermates fed a standard rodent diet. The control compound is injected at the same dose as the target-specific compound.

Throughout the treatment period, the rats are evaluated for food consumption, weight gain, as well as serum levels of glucose, insulin, cholesterol, free fatty acids, triglycerides and liver enzymes.

The effects of target modulation on glucose and insulin metabolism are also evaluated in the Levin rats treated with the oligomeric compounds of the invention. Plasma glucose and insulin are monitored throughout the treatment by analyzing blood samples. Glucose and tolerance are assessed in fed or fasted rats. After blood is collected for baseline glucose and insulin levels, a glucose challenge is administered, after which blood glucose and insulin levels are measured at 15, 20 or 30 minute intervals for up to 3 hours. Insulin tolerance is similarly analyzed, beginning with blood collection for baseline glucose and insulin levels, followed by an insulin challenge, after which blood glucose levels are measured at 15, 20 or 30 minute intervals for up to 3 hours. Plasma insulin and glucose are also measured at study termination.

At the end of the treatment period, the rats are sacrificed. Organs are removed and weighed, including liver, white adipose tissue, brown adipose tissue and spleen. Target RNA expression levels are measured in all tissues that are isolated, using quantitative real-time PCR. Target protein levels are also evaluated by immunoblot analysis using antibodies that specifically recognize the target protein.

Also evaluated at the end of the treatment period are serum lipids, serum free fatty acids, serum cholesterol (CHOL), liver triglycerides, fat tissue triglycerides and liver enzyme levels. Hepatic steatosis is assessed by measuring the liver triglyceride content and oil red O staining, as described supra.

The Levin rats that receive treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism, as described supra.

C57BL/6 on a High-Fat Diet (a Model of Diet-Induced Obesity (DIO)):

The C57BL/6 mouse strain is reported to be susceptible to hyperlipidemia-induced atherosclerotic plaque formation. Consequently, when these mice are fed a high-fat diet, they develop diet-induced obesity. Accordingly these mice are a useful model for the investigation of obesity and treatments designed to treat these conditions. In one embodiment of the present invention, the oligomeric compounds of the invention are tested in a model of diet-induced obesity.

Male C57BL/6 mice (7-weeks old) receive a 60% fat diet for 8 weeks, after which mice are subcutaneously injected with one or more of the oligomeric compounds of the invention at a dose of 25 mg/kg two times per week for 4 weeks. Saline-injected or control compound-injected animals serve as a control. After the treatment period, mice are sacrificed and target levels are evaluated in liver, BAT and WAT as described supra.

To assess the physiological effects resulting from modulation of target, the diet-induced obese mice that receive treatment are evaluated at the end of the treatment period for serum lipids, serum free fatty acids, serum cholesterol (CHOL), liver triglycerides, fat tissue triglycerides and liver enzyme levels. Hepatic steatosis is assessed by measuring the liver triglyceride content and oil red O staining, as described supra.

The effects of target modulation on glucose and insulin metabolism are also evaluated in the diet-induced obese mice treated with the oligomeric compounds of the invention. Plasma glucose is measured at the start of treatment and after 2 weeks and 4 weeks of treatment. Plasma insulin is similarly measured at the beginning of the treatment, and following 2 weeks and 4 weeks of treatment. Glucose and insulin tolerance tests are also administered in fed and fasted mice. Mice receive intraperitoneal injections of either glucose or insulin, and the blood glucose and insulin levels are measured before the insulin or glucose challenge and at 15, 20 or 30 minute intervals for up to 3 hours.

To assess the metabolic rate of diet-induced obese mice treated with the oligomeric compounds of the invention, the respiratory quotient and oxygen consumption of the mice is also measured.

The diet-induced obese mice that receive treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism, as described supra.

P-407 Mouse Model of Hyperlipidemia:

Poloxamer 407 (P-407), an inert block copolymer comprising a hydrophobic core flanked by hydrophilic polyoxyethelene units has been shown to induce hyperlipidemia in rodents. In the mouse, one injection, intraperitoneally, of P-407 (0.5 g/kg) produced hypercholesterolemia that peaked at 24 hours and returned to control levels by 96 hours following treatment (Palmer, et al., *Atherosclerosis,* 1998, 136, 115-123). Consequently, these mice are a useful model for the investigation of compounds that modulate hyperlipidemia. In accordance with the present invention, the oligomeric compounds of the invention are tested in the P-407 model of hyperlipidemia.

Seven-week old male C57B1/6 mice are divided into two groups; (1) control and (2) P-407 injected animals (0.5 g/kg every 3 days, following an overnight fast). Animals in each group receive either a saline injection or injection with one or more of the oligomeric compounds of the invention or control compounds at 25 mg/kg three times per week or 50 mg/kg two times per week. All injections are administered intraperitoneally.

After the treatment period, mice are sacrificed and target levels are evaluated in liver, BAT and WAT as described supra.

To assess the physiological effects resulting from modulation of target, the P-407 injected animals that receive treatment are evaluated at the end of the treatment period for serum lipids, serum free fatty acids, serum cholesterol (CHOL), liver triglycerides, fat tissue triglycerides and liver enzyme levels. Hepatic steatosis is assessed by measuring the liver triglyceride content and oil red O staining, as described supra.

The effects of target modulation on glucose and insulin metabolism are evaluated in the P-407 injected animals treated with the oligomeric compounds of the invention. Plasma glucose is measured at the start of the treatment and after 2 weeks and 4 weeks of treatment. Plasma insulin is similarly measured at the beginning of the treatment, and following 2 weeks and 4 weeks of treatment. Glucose and insulin tolerance tests are also administered in fed and fasted mice. Mice receive intraperitoneal injections of either glucose or insulin, and the blood glucose and insulin levels are measured before the insulin or glucose challenge and at 15, 20 or 30 minute intervals for up to 3 hours.

To assess the metabolic rate of P-407 injected animals treated with the oligomeric compounds of the invention, the respiratory quotient and oxygen consumption of the mice is measured.

The P-407 injected animals that receive treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism, as described supra.

ApoE Knockout Mice (a Model of Dyslipidemia and Obesity):

B6.129P-ApoE$^{tm1Unc}$ knockout mice (herein referred to as ApoE knockout mice) obtained from The Jackson Laboratory (Bar Harbor, Me.), are homozygous for the Apoe$^{tm1Unc}$ mutation and show a marked increase in total plasma cholesterol levels that are unaffected by age or sex. These animals present with fatty streaks in the proximal aorta at 3 months of age. These lesions increase with age and progress to lesions with less lipid but more elongated cells, typical of a more advanced stage of pre-atherosclerotic lesion.

The mutation in these mice resides in the apolipoprotein E (ApoE) gene. The primary role of the ApoE protein is to transport cholesterol and triglycerides throughout the body. It stabilizes lipoprotein structure, binds to the low density lipoprotein receptor (LDLR) and related proteins, and is present in a subclass of HDLs, providing them the ability to bind to LDLR. ApoE is expressed most abundantly in the liver and brain. In one embodiment of the present invention, female B6.129P-Apoetm1Unc knockout mice (ApoE knockout mice) are used in the following studies to evaluate the oligomeric compounds of the invention as potential lipid lowering compounds.

Female ApoE knockout mice range in age from 5 to 7 weeks and are placed on a normal diet for 2 weeks before study initiation. ApoE knockout mice are then fed ad libitum a 60% fat diet, with 0.15% added cholesterol to induce dyslipidemia and obesity. Control animals include ApoE knockout mice and ApoE wildtype mice (i.e. lean littermates) maintained on a high-fat diet with no added cholesterol. After overnight fasting, mice from each group are dosed intraperitoneally every three days with saline, 50 mg/kg of a control compound or 5, 25 or 50 mg/kg of one or more of the oligomeric compounds of the invention.

After the treatment period, mice are sacrificed and target levels are evaluated in liver, BAT and WAT as described supra.

To assess the physiological effects resulting from modulation of target, the ApoE knockout mice that receive treatment are evaluated at the end of the treatment period for serum lipids, serum free fatty acids, serum cholesterol (CHOL), liver triglycerides, fat tissue triglycerides and liver enzyme levels. Hepatic steatosis is assessed by measuring the liver triglyceride content and oil red O staining, as described supra.

The effects of target modulation on glucose and insulin metabolism are also evaluated in the ApoE knockout mice treated with the oligomeric compounds of the invention. Plasma glucose is measured at the start of the treatment and after 2 weeks and 4 weeks of treatment. Plasma insulin is similarly measured at the beginning of the treatment, and following 2 weeks and 4 weeks of treatment. Glucose and insulin tolerance tests are also administered in fed and fasted mice. Mice receive intraperitoneal injections of either glucose or insulin, and the blood glucose and insulin levels are measured before the insulin or glucose challenge and at 15, 20 or 30 minute intervals for up to 3 hours.

To assess the metabolic rate of ApoE knockout mice treated with the oligomeric compounds of the invention, the respiratory quotient and oxygen consumption of the mice are measured.

The ApoE knockout mice that receive treatment are evaluated at the end of the treatment period for the effects of target modulation on the expression of genes that participate in lipid metabolism, cholesterol biosynthesis, fatty acid oxidation, fatty acid storage, gluconeogenesis and glucose metabolism, as described supra.

In order that the invention disclosed herein may be more efficiently understood, examples are provided below. It should be understood that these examples are for illustrative purposes only and are not to be construed as limiting the invention in any manner. Throughout these examples, molecular cloning reactions, and other standard recombinant DNA techniques, were carried out according to methods described in Maniatis et al., Molecular Cloning—A Laboratory Manual, 2nd ed., Cold Spring Harbor Press (1989), using commercially available reagents, except where otherwise noted.

EXAMPLES

Example 1

Oligomeric Compounds Targeting Small Non-Coding RNAs

In accordance with the present invention, a series of oligomeric compounds are designed to target different regions of small non-coding target RNAs. The oligomeric compounds can be investigated for their effect on small non-coding RNA levels by quantitative real-time PCR. The target regions to which these sequences are complementary are herein referred to as "suitable target regions".

Example 2

Oligomeric Compounds that Mimic or Replace Small Non-Coding RNAs

In accordance with the present invention, a series of oligomeric compounds are designed to mimic the structure and/or function of small non-coding RNAs. These mimics may include isolated single-, double-, or multiple-stranded compounds, any of which may include regions of intrastrand nucleobase complementarity, said regions capable of folding and forming a molecule with fully or partially double-stranded or multiple-stranded character based on regions of precise or imperfect complementarity. The oligomeric compound mimics can then be investigated for their effects on a cell, tissue or organism system lacking endogenous small non-coding RNAs or systems with aberrant expression of small non-coding RNAs using the screening methods disclosed herein or those commonly used in the art. Changes in levels, expression or function of the small non-coding RNA or its downstream target nucleic acid levels can be analyzed by quantitative real-time PCR as described, supra.

Example 3

Pri-miRNAs Targeted by Compounds of the Present Invention

In accordance with the present invention, oligomeric compounds were designed to target one or more microRNA (miRNA) genes or gene products. Certain pri-miRNAs have been reported by Lim et al. *Science*, 2003, 299; 1540; in Brevia (detailed in the supplemental online materials; www.sciencemag.org/cgi/content/full/299/5612/1540/DC1) and these were used as starting targets.

A list of pri-miRNAs targeted is shown in Table 1. The gene name for each of the 188 targets (assigned by Lim et al.) is given in the table. For those pri-miRNAs that did not produce an identifiable miRNA detectable by PCR in the Lim publication, the position and sequence of the miRNAs were identified herein and are referred to as novel or hypothetical miRNAs. Also shown are the sequence of the pri-miRNA and the Genbank Accession number of the source sequence from which the pri-miRNA was extracted. The sequence is written in the 5' to 3' direction and is represented in the DNA form. It is understood that a person having ordinary skill in the art would be able to convert the sequence of the targets to their RNA form by simply replacing the thymidine (T) with uracil (U) in the sequence.

TABLE 1 pri-miRNAs

| pri-miRNA | pri-miRNA sequence | Genbank Accession # of source sequence | SEQ ID NO |
|---|---|---|---|
| mir-140 | CTGTGTGTGTCTCTCTCTGTGTCCTGCCAG TGGTTTTACCGTATGGTAGGTTACGTCATG CTGTTCTACCACAGGGTAGAACCACGGACA GGATACCGGGGCACCCTCTG | NT_037896.1 | 4 |
| mir-30a | TATATTGCTGTTGACAGTGAGCGACTGTAA ACATCCTCGACTGGAAGCTGTGAAGCCACA GATGGGCTTTCAGTCGGATGTTTGCAGCTG CCTACTGCCTCGGACTTCAA | NT_007299.11 | 5 |
| mir-34 | GGCCAGCTGTGAGTGTTTCTTTGGCAGTGT CTTAGCTGGTTGTTGTGAGCAATAGTAAGG AAGCAATCAGCAAGTATACTGCCCTAGAAG TGCTGCACGTTGTGGGGCCC | NT_028054.10 | 6 |
| mir-29b-1 | TCATTGAGATCCTGTTCTTCTGGAAGCTGG TTTCACATGGTGGCTTAGATTTTTCCATCT TTGTATCTAGCACCATTTGAAATCAGTGTT TTAGGAGTAAGAATTGCAGC | NT_021877.13 | 7 |
| mir-29b-2 | GATCATAAAGCTTCTTCAGGAAGCTGGTTT CATATGGTGGTTTAGATTTAAATAGTGATT GTCTAGCACCATTTGAAATCAGTGTTCTTG GGGGAGACCAGCTGCGCTGC | NT_007933.10 | 8 |
| mir-16-3 | ATGAACTGACATACTTGTTCCACTCTAGCA GCACGTAAATATTGGCGTAGTGAAATATAT ATTAAACACCAATATTACTGTGCTGCTTTA GTGTGACAGGGATACAGCAA | NT_005612.11 | 9 |
| mir-203 | GTGTTGGGGACTCGCGCGCTGGGTCCAGTG GTTCTTAACAGTTCAACAGTTCTGTAGCGC AATTGTGAAATGTTTAGGACCACTAGACCC GGCGGGCGCGGCGACAGCGA | NT_026437.9 | 10 |
| mir-7-1 | TTGGATGTTGGCCTAGTTCTGTGTGGAAGA CTAGTGATTTTGTTGTTTTAGATAACTAA ATCGACAACAAATCACAGTCTGCCATATGG CACAGGCCATGCCTCTACAG | NT_023935.13 | 11 |
| mir-10b | CCAGAGGTTGTAACGTTGTCTATATATACC CTGTAGAACCGAATTTGTGTGGTATCCGTA TAGTCACAGATTCGATTCTAGGGGAATATA TGGTCGATGCAAAAACTTCA | NT_037537.1 | 12 |
| mir-128a | TGCAATAATTGGCCTTGTTCCTGAGCTGTT GGATTCGGGGCCGTAGCACTGTCTGAGAGG TTTACATTTCTCACAGTGAACCGGTCTCTT TTTCAGCTGCTTCCTGGCTT | NT_034487.2 | 13 |
| mir-153-1 | TctctctctccctcACAGCTGCCAGTGTCA TTTTTGTGATCTGCAGCTAGTATTCTCACT CCAGTTGCATAGTCACAAAAGTGATCATTG GCAGGTGTGGCTGCTGCATG | NT_005403.11 | 14 |
| mir-153-2 | TGCCAGCTAATTAGCGGTGGCCAGTGTCAT TTTTGTGATGTTGCAGCTAGTAATATGAGC CCAGTTGCATAGTCACAAAAGTGATCATTG GAAACTGTGACTGTACTGCA | NT_007741.10 | 15 |
| hypothetical miRNA-013 | CTGGATGCCTTTTCTGCAGGCCTCTGTGTG ATATGTTTGATATATTAGGTTGTTATTTAA TCCAACTATATATCAAACATATTCCTACAG TGTCTTGCCCTGTCTCCGGG | NT_010194.13 | 16 |
| mir-27b | TGACCTCTCTAACAAGGTGCAGAGCTTAGC TGATTGGTGAACAGTGATTGGTTTCCGCTT TGTTCACAGTGGCTAAGTTCTGCACCTGAA GAGAAGGTGAGATGGGGACA | NT_008476.13 | 17 |
| mir-96 | CAGTGCCATCTGCTTGGCCGATTTTGGCAC TAGCACATTTTTGCTTGTGTCTCTCCGCTC | NT_007933.10 | 18 |

TABLE 1-continued pri-miRNAs

| pri-miRNA | pri-miRNA sequence | Genbank Accession # of source sequence | SEQ ID NO |
|---|---|---|---|
| | TGAGCAATCATGTGCAGTGCCAATATGGGA AAAGCAGGACCCGCAGCTGC | | |
| mir-17as/mir-91 | AGTCAGAATAATGTCAAAGTGCTTACAGTG CAGGTAGTGATATGTGCATCTACTGCAGTG AAGGCACTTGTAGCATTATGGTGACAGCTG CCTCGGGAAGCCAAGTTGGG | NT_009952.11 | 19 |
| mir-123/mir-126as | GCCACGCCTCCGCTGGCGACGGGACATTAT TACTTTTGGTACGCGCTGTGACACTTCAAA CTCGTACCGTGAGTAATAATGCGCCGTCCA CGGCACCGCATCGAAAACGC | NT_024000.13 | 20 |
| mir-132 | CgcgccccgccccgcGTCTCCAGGGCAAC CGTGGCTTTCGATTGTTACTGTGGGAACTG GAGGTAACAGTCTACAGCCATGGTCGCCCC GCAGCACGCCCACGCGCCGC | NT_010692.9 | 21 |
| mir-108-1 | GCTGCCCGATGCACACTGCAAGAACAATAA GGATTTTTAGGGGCATTATGACTGAGTCAG AAAACACAGCTGCCCCTGAAAGTCCCTCAT TTTTCTTGCTGTCCTTGAAC | NT_010799.11 | 22 |
| mir-23b | GCGCTGCTCTCAGGTGCTCTGGCTGCTTGG GTTCCTGGCATGCTGATTTGTGACTTAAGA TTAAAATCACATTGCCAGGGATTACCACGC AACCACGACCTTGGCTGCTC | NT_008476.13 | 23 |
| let-7i | ACACCATGGCCCTGGCTGAGGTAGTAGTTT GTGCTGTTGGTCGGGTTGTGACATTGCCCG CTGTGGAGATAACTGCGCAAGCTACTGCCT TGCTAGTGCTGGTGATGCTC | NT_009711.13 | 24 |
| mir-212 | CGGGGCACCCCGCCCGGACAGCGCGCCGGC ACCTTGGCTCTAGACTGCTTACTGCCCGGG CCGCCCTCAGTAACAGTCTCCAGTCACGGC CACCGACGcctggccccgcc | NT_010692.9 | 25 |
| hypothetical miRNA-023 | AGATTTAATTAGCTCAGAGAAGAAATGTTG CTTGGGCAAGAGGACTTTTTAATTATCAGC TTGGATAAATTTGAAAATGTTGATGCCTAG GGGTTGAGTTAATTAAAACC | NT_004658.12 | 26 |
| mir-131-2 | GCCTGTGTGGGAAGCGAGTTCTTATCTTTG GTTATCTAGCTGTATGAGTGTATTGGTCTT CATAAAGCTAGATAACCGAAAGTAAAAACT CCTTCAAGATCGCCGGGGAG | NT_029973.6 | 27 |
| let-7b | GGCCGGGCCTGGCGGGGTGAGGTAGTAGGT TGTGTGGTTTCAGGGCAGTGATGTTGCCCC TCGGAAGATAACTATACAACCTACTGCCTT CCCTGAGGAGCCCAGTGACA | NT_011523.8 | 28 |
| mir-1d | CTGCATGCAGACTGCCTGCTTGGGAAACAT ACTTCTTTATATGCCCATATGGACCTGCTA AGCTATGGAATGTAAAGAAGTATGTATCTC AGGCCGGGACCTCTCTCGCC | NT_035608.1 | 29 |
| mir-122a | TGGCTACAGAGTTTCCTTAGCAGAGCTGTG GAGTGTGACAATGGTGTTTGTGTCTAAACT ATCAAACGCCATTATCACACTAAATAGCTA CTGCTAGGCAATCCTTCCCT | NT_033907.3 | 30 |
| mir-22 | GCCCTCACCTGGCTGAGCCGCAGTAGTTCT TCAGTGGCAAGCTTTATGTCCTGACCCAGC TAAAGCTGCCAGTTGAAGAACTGTTGCCCT CTGCCCCTGGCTTCGAGGAG | NT_010692.9 | 31 |
| mir-92-1 | AAGGGAAACTCAAACCCGTTTCTACACAGG TTGGGATCGGTTGCAATGCTGTGTTTCTGT ATGGTATTGCACTTGTCCCGGCCTGTTGAG TTTGGTGGGGATTGTGACCA | NT_009952.11 | 32 |

TABLE 1-continued pri-miRNAs

| pri-miRNA | pri-miRNA sequence | Genbank Accession # of source sequence | SEQ ID NO |
|---|---|---|---|
| hypothetical miRNA-030 | CTACTGCTGTTGGTGGCAGCTTGGTGGTCG TATGTGTGACGCCATTTACTTGAACCTTTA GGAGTGACATCACATATACGGCAGCTAAAC TGCTACATGGGACAACAATT | NT_007933.10 | 33 |
| mir-142 | CGACGGACAGACAGACAGTGCAGTCAGCCA TAAAGTAGAAAGCACTACTAACAGCACTGG AGGGTGTAGTGTTTCCTACTTTATGGATGA GTGTACTGTGGGCTTCGGAG | NT_010783.11 | 34 |
| mir-183 | CCGCAGAGTGTGACTCCTGTTCTGTGTATG GCACTGGTAGAATTCACTGTGAACAGTCTC AGTCAGTGAATTACCGAAGGGCCATAAACA GAGGAGAGACAGATCCACGA | NT_007933.10 | 35 |
| hypothetical miRNA-033 | TGGTGTGGCAACCCCTAAAGGCTCAGGATT AAGGTGGGTGAATAATATAACAATATCCG TGTTGTTATAGTATTCCACCTACCCTGATG CATTTGTTGTCATTTTCTT | NT_011588.11 | 36 |
| mir-214 | GGCCTGGGTGGACAGAGTTGTCATGTGTCT GCCTGTCTACACTTGCTGTGCAGAACATCC GCTCACCTGTACAGCAGGCACAGACAGGCA GTCACATGACAACCCAGCCT | NT_029874.7 | 37 |
| mir-143 | AGCAGCGCAGCGCCCTGTCTCCCAGCCTGA GGTGGAGTGCTGCATCTCTGGTCAGTTGGG AGTCTGAGATGAAGCACTGTAGCTCAGGAA GAGAGAAGTTGTTCTGCAGC | NT_006859.11 | 38 |
| mir-192-1 | GCCGAGACCGAGTGCACAGGGCTCTGACCT ATGAATTGACAGCCAGTGCTCTCGTCTCCC CTCTGGCTGCCAATTCCATAGGTCACAGGT ATGTTCGCCTCAATGCCAGC | NT_033241.3 | 39 |
| mir-192-2 | GCCGAGACCGAGTGCACAGGGCTCTGACCT ATGAATTGACAGCCAGTGCTCTCGTCTCCC CTCTGGGTGCCAATTCCATAGGTCACAGGT ATGTTCGCCTCAATGCCAGC | NT_033241.3 | 39 |
| mir-192-3 | GCCGAGACCGAGTGCACAGGGCTCTGACCT ATGAATTGACAGCCAGTGCTCTCGTCTCCC CTCTGGCTGCCAATTCCATAGGTCACAGGT ATGTTCGCCTCAATGCCAGC | NT_033241.3 | 39 |
| hypothetical miRNA-039 | CCGCTGTGCCTTGGGCGGGCGGCTGTTAAG ACTTGCAGTGATGTTTAACTCCTCTCCACG TGAACATCACAGCAAGTCTGTGCTGCTTCC CGTCCCTACGCTGCCTGGGC | NT_028392.4 | 42 |
| hypothetical miRNA-040 | GCCAGCAAATAATGGCTGTTGTATTAGCTG CTTTTGATGATAGTATGAAAGAAGTATTAG CACTTGTCAACAAAACTGCTTACAACATAA CATTAGCATGCATGGGCTGC | NT_023148.9 | 43 |
| hypothetical miRNA-041 | CATACACGGCTGTTACACAGGTTTTCCCAT GATAAGGCAATAGGTTAATGAAATGCTCAT TTCATTTTACCAGTTGTTTTCTCTGTGAAG TTCCGATAAGTAGCAAACCA | NT_023089.11 | 44 |
| let-7a-3 | CGACTGCCCTTTGGGGTGAGGTAGTAGGTT GTATAGTTTGGGGCTCTGCCCTGCTATGGG ATAACTATACAATCTACTGTCTTTCCTGAA GTGGCTGTAATATCTGCGGT | NT_011523.8 | 45 |
| hypothetical miRNA-043 | CCCCTTATAGGCCCATTTTGACAGGAAATC TTTGAGAGGCAGCAGCAATGAAGTGCCCAG AGATTTCATCTGTCTTCTTTTGCTTTAGGA AATGCTGAGCGCAAGGCTCC | NT_004902.12 | 46 |

TABLE 1-continued pri-miRNAs

| pri-miRNA | pri-miRNA sequence | Genbank Accession # of source sequence | SEQ ID NO |
|---|---|---|---|
| hypothetical miRNA-044 | GCCTGAAATGAAATTACCATATTTTTAATC TTAATTTTCCACTCTGTTTATCTGACAGTG TGGATGTGCAATCGAAACAGATAATGAGAG AGTGGGATATTGACACCGCT | NT_009952.11 | 47 |
| mir-181a | AGAAGGGCTATCAGGCCAGCCTTCAGAGGA CTCCAAGGAACATTCAACGCTGTCGGTGAG TTTGGGATTTGAAAAAACCACTGACCGTTG ACTGTACCTTGGGGTCCTTA | NT_017568.11 | 48 |
| let-7a-1 | GTTCTCTTCACTGTGGGATGAGGTAGTAGG TTGTATAGTTTTAGGGTCACACCCACCACT GGGAGATAACTATACAATCTACTGTCTTTC CTAACGTGATAGAAAAGTCT | NT_008476.13 | 49 |
| mir-205 | AAAGATCCTCAGACAATCCATGTGCTTCTC TTGTCCTTCATTCCACCGGAGTCTGTCTCA TACCCAACCAGATTTCAGTGGAGTGAAGTT GAGGAGGCATGGAGCTGACA | NT_021877.13 | 50 |
| mir-103-1 | GAAGTTTTCTTACTGCCCTCGGCTTCTTTA CAGTGCTGCCTTGTTGCATATGGATCAAGC AGCATTGTACAGGGCTATGAAGGCATTGAG ACCTGTTCTTCATGATATTT | NT_037665.1 | 51 |
| mir-26a | GGCCCTGGCGAAGGCCGTGGCCTCGTTAA GTAATCCAGGATAGGCTGTGCAGGTCCCAA TGGCCTATCTTGGTTACTTGCACGGGACG CGGGCCTGGACGCCGGCATC | NT_005580.13 | 52 |
| mir-33a | GGCCGCATACCTCCTGGCGGGCAGCTGTGG TGCATTGTAGTTGCATTGCATGTTCTGGTG GTACCCATGCAATGTTTCCACAGTGCATCA CAGAGGCCTGCCTGGCCCTC | NT_011520.8 | 53 |
| mir-196-2 | TGCTCGCTCAGCTGATCTGTGGCTTAGGTA GTTTCATGTTGTTGGGATTGAGTTTTGAAC TCGGCAACAAGAAACTGCCTGAGTTACATC AGTCGGTTTTCGTCGAGGGC | NT_009458.12 | 54 |
| mir-107 | TGCAATATTCGATATTCTCTCTGCTTTCAG CTTCTTTACAGTGTTGCCTTGTGGCATGGA GTTCAAGCAGCATTGTACAGGGCTATCAAA GCACAGAGAGCTTGCTACAG | NT_033890.3 | 55 |
| mir-106 | AAATTTTGCTACAGGAATAGGGCTTGGCCA TGTAAAAGTGCTTACAGTGCAGGTAGCTTT TTGAGATCTACTGCAATGTAAGCACTTCTT ACATTACCATGGTGATTTAG | NT_011786.11 | 56 |
| let-7f-1 | ATTGCTCTATCAGAGTGAGGTAGTAGATTG TATAGTTGTGGGGTAGTGATTTTACCCTGT TCAGGAGATAACTATACAATCTATTGCCTT CCCTGAGGAGTAGACTTGCT | NT_008476.13 | 57 |
| hypothetical miRNA-055 | TTGAGCATGATGAATGATTGGAGTCAGAGA AGCGGCGTGATAAATGGCAGCACCTTGGCT CCATTGCATGCCCTATTGATTCTCCTTCTT TATTACTCCTAGAACCCAGC | NT_006713.11 | 58 |
| mir-29c | ACCACTGGCCCATCTCTTACACAGGCTGAC CGATTTCTCCTGGTGTTCAGAGTCTGTTTT TGTCTAGCACCATTTGAAATCGGTTATGAT GTAGGGGGAAAAGCAGCAGC | NT_021877.13 | 59 |
| mir-130a | CCGGCATGCCTCTGCTGCTGGCCAGAGCTC TTTTCACATTGTGCTACTGTCTGCACCTGT CACTAGCAGTGCAATGTTAAAAGGGCATTG GCCGTGTAGTGCTACCCAGC | NT_033903.3 | 60 |

TABLE 1-continued pri-miRNAs

| pri-miRNA | pri-miRNA sequence | Genbank Accession # of source sequence | SEQ ID NO |
|---|---|---|---|
| hypothetical miRNA-058 | TATCATCTTGTCAGATGCTTAATGTTCTTC CTCCTGTCACTTTGGATAGGCCCAATTTGT AGAATACTGCAGAGGTAAAAGAAGACAATT AACAGTGACAGGATGGTAAT | NT_037537.1 | 61 |
| mir-218-1 | GTGATAATGTAGCGAGATTTTCTGTTGTGC TTGATCTAACCATGTGGTTGCGAGGTATGA GTAAAACATGGTTCCGTCAAGCACCATGGA ACGTCACGCAGCTTTCTACA | NT_006316.13 | 62 |
| mir-124a-2 | ATCAAGATTAGAGGCTCTGCTCTCCGTGTT CACAGCGGACCTTGATTTAATGTCATACAA TTAAGGCACGCGGTGAATGCCAAGAGCGGA GCCTACGGCTGCACTTGAAG | NT_008183.13 | 63 |
| mir-21 | CTCCATGGCTGTACCACCGTTGTCGGGTAGC TTATCAGACTGATGTTGACTGTTGAATCTC ATGGCAACACCAGTCGATGGGCTGTCTGAC ATTTTGGTATCTTTCATCTG | NT_035426.2 | 64 |
| mir-16-1 | AGCTCTTATGATAGCAATGTCAGCAGTGCC TTAGCAGCACGTAAATATTGGCGTTAAGAT TCTAAAATTATCTCCAGTATTAACTGTGCT GCTGAAGTAAGGTTGACCAT | NT_033922.3 | 65 |
| mir-144 | TCCTGTGCCCCCAGTGGGGCCCTGGCTGGG ATATCATCATATACTGTAAGTTTGCGATGA GACACTACAGTATAGATGATGTACTAGTCC GGGCACCCCCAGCTCTGGAG | NT_010799.11 | 66 |
| mir-221 | TGAACATCCAGGTCTGGGGCATGAACCTGG CATACAATGTAGATTTCTGTGTTCGTTAGG CAACAGCTACATTGTCTGCTGGGTTTCAGG CTACCTGGAAACATGTTCTC | NT_011568.10 | 67 |
| mir-222 | GCTGCTGGAAGGTGTAGGTACCCTCAATGG CTCAGTAGCCAGTGTAGATCCTGTCTTTCG TAATCAGCAGCTACATCTGGCTACTGGGTC TCTGATGGCATCTTCTAGCT | NT_011568.10 | 68 |
| mir-30d | TCTTGTTCAGAAAGTCTGTTGTTGTAAACA TCCCCGACTGGAAGCTGTAAGACACAGCTA AGCTTTCAGTCAGATGTTTGCTGCTACCGG CTATTGACAGACATCCTCTT | NT_028251.8 | 69 |
| mir-19b-2 | CAAAGACATTGCTACTTACAATTAGTTTTG CAGGTTTGCATTTCAGCGTATATATGTATA TGTGGCTGTGCAAATCCATGCAAAACTGAT TGTGATAATGTGTGCTTCCT | NT_011786.11 | 70 |
| mir-128b | GCCCGGCAGCCACTGTGCAGTGGGAAGGGG GGCCGATACACTGTACGAGAGTGAGTAGCA GGTCTCACAGTGAACCGGTCTCTTTCCCTA CTGTGTCACACTCCTAATGG | NT_005580.13 | 71 |
| hypothetical miRNA-069 | GGGCCCTGAACTCAGGGGCTTCGGCACTGA TTGTCCAAACGCAATTCTTGTACGAGTCTG CGGCCAACCGAGAATTGTGGCTGGACATCT GTGGCTGAGCTCCGGGCGCA | NT_017568.11 | 72 |
| hypothetical miRNA-070 | TTCGATGCTTGAAGATGTCAGACTGTAGAA TCTCTACGGGTAAGTGTGTGATTTCCTCAG TGACATCACATTTGCCTGCAGAGATTTTCC AGTCTGCCACTTTGAAGTTG | NT_005375.11 | 73 |
| hypothetical miRNA-071 | GCTTGCTGTAGGCTGTATGCTGTTAATGCT AATCGTGATAGGGGTTTTTGCCTCCAACTG ACTCCTACATATTAGCATTAACAGTGTATG ATGCCTGTTACTAGCATTCA | NT_011512.7 | 74 |

TABLE 1-continued pri-miRNAs

| pri-miRNA | pri-miRNA sequence | Genbank Accession # of source sequence | SEQ ID NO |
|---|---|---|---|
| mir-29b-3 | AAGCTTCTTCAGGAAGCTGGTTTCATATGG TGGTTTAGATTTAAATAGTGATTGTCTAGC ACCATTTGAAATCAGTGTTCTTGGGGGAGA CCAGCTGCGCTGCACTACCA | NT_007933.10 | 75 |
| mir-129-2 | GGCATATTCTGCCCTTCGCGAATCTTTTTG CGGTCTGGGCTTGCTGTACATAACTCAATA GCCGGAAGCCCTTACCCCAAAAAGCATTTG CGGAGGGCGCACTCGTCGAG | NT_009237.13 | 76 |
| mir-133b | CAGAAGAAAGATGCCCCCTGCTCTGGCTGG TCAAACGGAACGAAGTCCGTCTTCCTGAGA GGTTTGGTCCCCTTCAACCAGCTACAGCAG GGCTGGCAATGCCCAGTCCT | NT_007592.11 | 77 |
| hypothetical miRNA-075 | AGCGCAGCTTTAATTACTCATGCTGCTGGT TAAAATATTAATGGGCACAGAGTGTTGCA TGCTCATTTCTGTTGATTTTTAATTAGCAG TAATTCATTTTGCACAAAGC | NT_006044.8 | 78 |
| let-7d | AAAAAAATGGGTTCCTAGGAAGAGGTAGTA GGTTGCATAGTTTTAGGGCAGGGATTTTGC CCACAAGGAGGTAACTATACGACCTGCTGC CTTTCTTAGGGCCTTATTAT | NT_008476.13 | 79 |
| mir-15b | AATCCTACATTTTTGAGGCCTTAAAGTACT GTAGCAGCACATCATGGTTTACATGCTACA GTCAAGATGCGAATCATTATTTGCTGCTCT AGAAATTTAAGGAAATTCAT | NT_005612.11 | 80 |
| mir-29a-1 | ACGACCTTCTGTGACCCCTTAGAGGATGAC TGATTTCTTTTGGTGTTCAGAGTCAATATA ATTTTCTAGCACCATCTGAAATCGGTTATA ATGATTGGGGAAGAGCACCA | NT_007933.10 | 81 |
| hypothetical miRNA-079 | CAAAGCTCTCCTGCCTGCTTCTGTGTGATA TGTTTGATATTGGGTTGTTTAATTAGGAAC CAACTAAATGTCAAACATATTCTTACAGCA GCAGGTGATTCAGCACCACC | NT_021907.13 | 82 |
| mir-199b | CCAGAGGACACCTCCACTCCGTCTACCCAG TGTTTAGACTATCTGTTCAGGACTCCCAAA TTGTACAGTAGTCTGCACATTGGTTAGGCT GGGCTGGGTTAGACCCTCGG | NT_017568.11 | 83 |
| mir-129-1 | GGATGGCTGCTGTCTCCTTTGGATCTTTTT GCGGTCTGGGCTTGCTGTTCCTCTCAACAG TAGTCAGGAAGCCCTTACCCCAAAAAGTAT CTGCGGGAGGCCTTGTCCAC | NT_007933.10 | 84 |
| let-7e | ACCTGCCGCGCCCCCCGGGCTGAGGTAGGA GGTTGTATAGTTGAGGAGGACACCCAAGGA GATCACTATACGGCCTCCTAGCTTTCCCCA GGCTGCGCCCTGCACGGGAC | NT_011109.13 | 85 |
| hypothetical miRNA-083 | TGGCAGGTTGTTTAGTTTTTTCGTTTGAAG GTTTTCATTAGTCTAATGAGGACTGTGCAA GGGCGAGCAGTCAGCACAATTTACATGGGG AAGCTATCATAATAAATGAA | NT_024524.11 | 86 |
| let-7c | AGCTGTGTGCATCCGGGTTGAGGTAGTAGG TTGTATGGTTTAGAGTTACACCCTGGGAGT TAACTGTACAACCTTCTAGCTTTCCTTGGA GCACACTTGAGCCGTCGAGG | NT_011512.7 | 87 |
| mir-204 | GGCTACAGTCTTTCTTCATGTGACTCGTGG ACTTCCCTTTGTCATCCTATGCCTGAGAAT ATATGAAGGAGGCTGGGAAGGCAAAGGGAC GTTCAATTGTCATCACTGGC | NT_008580.11 | 88 |

TABLE 1-continued pri-miRNAs

| pri-miRNA | pri-miRNA sequence | Genbank Accession # of source sequence | SEQ ID NO |
|---|---|---|---|
| mir-145 | CCACTCGCTCCCACCTTGTCCTCACGGTCC AGTTTTCCCAGGAATCCCTTAGATGCTAAG ATGGGGATTCCTGGAAATACTGTTCTTGAG GTCATGGTTTCACAGCTGGA | NT_006859.11 | 89 |
| mir-124a-1 | tccttcctCAGGAGAAAGGCGTCTCTCTCC GTGTTCACAGCGGACCTTGATTTAAATGTC CATACAATTAAGGCACGCGGTGAATGCCAA GAATGGGGCTGGCTGAGCAC | NT_019483.13 | 90 |
| hypothetical miRNA-088 | AGTCGCCAGTCACTTAAGCTGAGTGCATTG TGATTTCCAATAATTGAGGCAGTGGTTCTA AAAGCTGTCTACATTAATGAAAAGAGCAAT GTGGCCAGCTTGACTAAGCC | NT_011519.9 | 91 |
| mir-213 | TGAGTTTTGAGGTTGCTTCAGTGAACATTC AACGCTGTCGGTGAGTTTGGAATTAAAATC AAAACCATCGACCGTTGATTGTACCCTATG GCTAACCATCATCTACTCCA | NT_029862.8 | 92 |
| hypothetical miRNA-090 | CAGCGATACATTAATGCTCATTTGGCTCTG CAAATCTTACCGTTTGCTTAGGCCAAATGG CGCATCAATGACTATCGCTCTTACAAAGCT CTTGAATCAGTATTATGTAA | NT_006171.13 | 93 |
| mir-20 | TATCTGATGTGACAGCTTCTGTAGCACTAA AGTGCTTATAGTGCAGGTAGTGTTTAGTTA TCTACTGCATTATGAGCACTTAAAGTACTG CTAGCTGTAGAACTCCAGCT | NT_009952.11 | 94 |
| mir-133a-1 | CTAGCAGCACTACAATGCTTTGCTAGAGCT GGTAAAATGGAACCAAATCGCCTCTTCAAT GGATTTGGTCCCCTTCAACCAGCTGTAGCT ATGCATTGATTACTACGGGA | NT_011044.11 | 95 |
| mir-138-2 | GCGGAGTTCTGGTATCGTTGCTGCAGCTGG TGTTGTGAATCAGGCCGACGAGCAGCGCAT CCTCTTACCCGGCTATTTCACGACACCAGG GTTGCATCATACCCATCCTC | NT_010498.11 | 96 |
| mir-98 | CTGCTCATGCCAGGGTGAAGTAGTAAGTTG TATTGTTGTGGGGTAGGGATATTAGGCCCC AATTAGAAGATAACTATACAACTTACTACT TTCCCTGGTGTGTGGCATAT | NT_011799.10 | 97 |
| mir-196-1 | CTACAGCTTGAATTGGAACTGCTGAGTGAA TTAGGTAGTTTCATGTTGTTGGGCCTGGGT TTCTGAACACAACAACATTAAACCACCCGA TTCACGGCAGTTACTGCTCC | NT_010783.11 | 98 |
| mir-125b-1 | AACATTGTTGCGCTCCTCTCAGTCCCTGAG ACCCTAACTTGTGATGTTTACCGTTTA~AT CCACGGGTTAGGCTCTTGGGAGCTGCGAGT CGTGCTTTTGCATCCTGGAA | NT_033899.3 | 99 |
| mir-199a-2 | AGGAAGCTTCTGGAGATCCTGCTCCGTCGC CCCAGTGTTCAGACTACCTGTTCAGGACAA TGCCGTTGTACAGTAGTCTGCACATTGGTT AGACTGGGCAAGGGAGAGCA | NT_029874.7 | 100 |
| mir-29a-2 | ACCTTCTGTGACCCCTTAGAGGATGAGTGA TTTCTTTTGGTGTTCAGAGTCAATATAATT TTCTAGCACCATCTGAAATCGGTTATTTTG ATTGGGGAAGAGCACCATGA | NT_007933.10 | 101 |
| hypothetical miRNA-099 | CTGGGGAGGTGAGCCTGAAAACAAAGGCAG ATAGAGAAGTCACAGCTCACTGGTGAGGGA GGTAGAGAGTTGTTTTCTTAATACCCTCTG CCTTTTGAATCTGCCTAGATT | NT_016297.12 | 102 |

TABLE 1-continued pri-miRNAs

| pri-miRNA | pri-miRNA sequence | Genbank Accession # of source sequence | SEQ ID NO |
|---|---|---|---|
| mir-181b | CCTGTGCAGAGATTATTTTTTAAAAGGTCA CAATCAACATTCATTGCTGTCGGTGGGTTG AACTGTGTGGACAAGCTCACTGAACAATGA ATGCAACTGTGGCCCCGCTT | NT_029862.8 | 103 |
| hypothetical miRNA-101 | GTATATTCAGGGACAGGCCATTGACAGTCA ATTAACAAGTTTGATTGGTATGTCAACTCA TTCTTTTGAATTGTTAATAGTATGTTAATA GCATTCGTTTCTTTGTGCAG | NT_030828.7 | 104 |
| mir-141 | CTGTCGGCCGGCCCTGGGTCCATGTTCCAG TACAGTGTTGGATGGTCTAATTGTGAAGCT CCTAACACTGTCTGGTAAAGATGGCTCCCG GGTGGGTTCTCTCGGCAGTA | NT_035206.1 | 105 |
| mir-131-1 | gccaggaggcggGGTTGGTTGTTATCTTTG GTTATCTAGCTGTATGAGTGGTGTGGAGTC TTCATAAAGCTAGATAACCGAAAGTAAAAA TAACCCCATACACTGCGCAG | NT_004858.13 | 106 |
| mir-133a-2 | TCGGATCTGGGAGCCAAATGCTTTGCTAGA GCTGGTAAAATGGAACCAAATCGACTGTGC AATGGATTTGGTCCCCTTCAACCAGCTGTA GCTGTGCATTGATGGCGCCG | NT_035608.1 | 107 |
| hypothetical miRNA-105 | CCGCCTCAGAGCCGCCCGCCGTTCCTTTTT CCTATGCATATACTTCTTTGAGGATCTGGC CTAAAGAGGTATAGGGCATGGGAAAACGGG GCGGTCGGGTCCTCCCCAGC | NT_017795.13 | 108 |
| hypothetical miRNA-106 | CGGCTCAGAGCCGCCCGCCGTTCCTTTTTC CTATGCATATACTTCTTTGAGGATCTGGCC TAAAGAGGTATAGGGCATGGGAAAACGGGG CGGTCGGGTCCTCCCCAGCG | NT_017795.13 | 109 |
| hypothetical miRNA-107 | CTATAATGCTTAGATTATCAATCATCTTGA CAGTTTATTGGCTTTATCACCACACATACC ATTAAAATGATGTGTGGCCTAGACTGTCAG GAGCAAACATTAAACAGACC | NT_008583.13 | 110 |
| mir-1b | ACAGCTAACAACTTAGTAATACCTACTCAG AGTACATACTTCTTTATGTACCCATATGAA CATACAATGCTATGGAATGTAAAGAAGTAT GTATTTTTGGTAGGCAATAA | NT_011044.11 | 111 |
| mir-18 | ATGTTGAGTGCTTTTTGTTCTAAGGTGCAT CTAGTGCAGATAGTGAAGTAGATTAGCATC TACTGCCCTAAGTGCTCCTTCTGGCATAAG AAGTTATGTATTCATCCAAT | NT_009952.11 | 112 |
| mir-220 | GACAGTGTGGCATTGTAGGGCTCCACACCG TATCTGACACTTTGGGCGAGGGCACCATGC TGAAGGTGTTCATGATGCGGTCTGGGAACT CCTCACGGATCTTACTGATG | NT_011588.11 | 113 |
| hypothetical miRNA-111 | CTCTGGCCTCCGCTTCCTCCTCCTCCGACT CGGACACCGGCGGAGCCTCCCCGCCCCCGC GGAAGAAACCCCGAGCCTCGGCGGCGGAGG GAGTAGGAGAGCCCGGGGCT | NT_004525.13 | 114 |
| mir-7-3 | AGATTAGAGTGGCTGTGGTCTAGTGCTGTG TGGAAGACTAGTGATTTTGTTGTTCTGATG TACTACGACAACAAGTCACAGCCGGCCTCA TAGCGCAGACTCCCTTCGAC | NT_011255.11 | 115 |
| mir-218-2 | GACCAGTCGCTGCGGGGCTTTCCTTTGTGC TTGATCTAACCATGTGGTGGAACGATGGAA ACGGAACATGGTTCTGTCAAGCACCGCGGA AAGCACCGTGCTCTCCTGCA | NT_023132.10 | 116 |

TABLE 1-continued pri-miRNAs

| pri-miRNA | pri-miRNA sequence | Genbank Accession # of source sequence | SEQ ID NO |
|---|---|---|---|
| mir-24-2 | GCCTGGCCTCCCTGGGCTCTGCCTCCCGTG CCTACTGAGCTGAAACACAGTTGGTTTGTG TACACTGGCTCAGTTCAGCAGGAACAGGGG TCAAGCCCCCTTGGAGCCTG | NT_031915.4 | 117 |
| mir-24-1 | CTGTCGATTGGACCCGCCCTGCGGTGCCTA CTGAGCTGATATCAGTTCTCATTTTACACA CTGGCTCAGTTCAGCAGGAACAGGAGTCGA GCCCTTGAGCAAAAAGCCTT | NT_008476.13 | 118 |
| mir-103-2 | CTCAGCAGAGCTGCGTCTTTGTGCTTTCAG CTTCTTTACAGTGCTGCCTTGTAGCATTCA GGTCAAGCAGCATTGTACAGGGCTATGAAA GAACCAAGAATGGGCTGCCC | NT_011387.8 | 119 |
| mir-211 | TCACCTGGCCATGTGACTTGTGGGCTTCCC TTTGTCATCCTTCGCCTAGGGCTCTGAGCA GGGCAGGGACAGCAAAGGGGTGCTCAGTTG TCACTTCCCACAGCACGGAG | NT_010363.13 | 120 |
| mir-101-3 | AGGTAGATATGAGACTGAACTGTCCTTTTT CGGTTATCATGGTACCGATGCTGTATATCT GAAAGGTACAGTACTGTGATAACTGAAGAA TGGTGGTGCCATCACATTGA | NT_008413.13 | 121 |
| mir-30b | CCAAGTTTCAGTTCATGTAAACATCCTACA CTCAGCTGTAATACATGGATTGGCTGGGAG GTGGATGTTTACTTCAGCTGACTTGGAATG TCAACCAATTAACATTGATA | NT_028251.8 | 122 |
| hypothetical miRNA-120 | GGCTTCTTCCAGTCATCCTGAGGTAGATAT CATCCAGGAATGCTGAGGCCTTATGGCTTA CAGCAATCCAGTAATGATATAAAAGGTGAT TGGAGGTTAGATTTACATTG | NT_009952.11 | 123 |
| let-7a-4 | TGTGACTGCATGCTCCCAGGTTGAGGTAGT AGGTTGTATAGTTTAGAATTACATCAAGGG AGATAACTGTACAGCCTCCTAGCTTTCCTT GGGTCTTGCACTAAACAACA | NT_033899.3 | 124 |
| mir-10a | GATCTGTCTGTCTTCTGTATATACCCTGTA GATCCGAATTTGTGTAAGGAATTTTGTGGT CACAAATTCGTATCTAGGGGAATATGTAGT TGACATAAACACTCCGCTCT | NT_010783.11 | 125 |
| mir-19a | TTGCAGTCCTCTGTTAGTTTTGCATAGTTG CACTACAAGAAGAATGTAGTTGTGCAAATC TATGCAAAACTGATGGTGGCCTGCTATTTC CTTCAAATGAATGATTTTA | NT_009952.11 | 126 |
| let-7f-2 | ACACTGGTGCTCTGTGGGATGAGGTAGTAG ATTGTATAGTTTTAGGGTCATACCCCATCT TGGAGATAACTATAGAGTCTACTGTCTTTC CCACGGTGGTACACTTCTTC | NT_011799.10 | 127 |
| mir-15a-1 | CGCGAATGTGTGTTTAAAAAAAATAAAACC TTGGAGTAAAGTAGCAGCACATAATGGTTT GTGGATTTTGAAAAGGTGCAGGCCATATTG TGCTGCCTCAAAAATACAAG | NT_010393.11 | 128 |
| mir-108-2 | CCGAGGAATACTGCAAGAGCAATAAGGATT TTAGGGGCATTATGATAGTGGAATGGAAA CACATCTGCCCCCAAAAGTCCCTCATTTTC CCTGCGGTAACGAACCAGCT | NT_034392.2 | 129 |
| mir-137 | cTTGGTCCTCTGACTCTCTTCGGTGACGGG TATTCTTGGGTGGATAATACGGATTACGTT GTTATTGCTTAAGAATACGCGTAGTCGAGG AGAGTACCAGCGGCAGGGGG | NT_033951.3 | 130 |

TABLE 1-continued pri-miRNAs

| pri-miRNA | pri-miRNA sequence | Genbank Accession # of source sequence | SEQ ID NO |
|---|---|---|---|
| mir-219 | CCGCCCCGGGCCGCGGCTCCTGATTGTCCA AACGCAATTCTCGAGTCTATGGCTCCGGCC GAGAGTTGAGTCTGGACGTCCCGAGCCGCC GCCCCCAAACCTCGAGCGGG | NT_007592.11 | 131 |
| mir-148b | CATTTCCAAGCACGATTAGCATTTGAGGTG AAGTTCTGTTATACACTCAGGCTGTGGCTC TCTGAAAGTCAGTGCATCACAGAACTTTGT CTCGAAAGCTTTCTAGCAGC | NT_009458.12 | 132 |
| mir-130b | GGGGAGGCACTGGCAGGCCTGCCCGACACT CTTTCCCTGTTGCACTACTATAGGCCGCTG GGAAGCAGTGCAATGATGAAAGGGCATCGG TCAGGTCCAGCCTGCTACCC | NT_011520.8 | 133 |
| mir-19b-1 | CCTGTTACTGAACACTGTTCTATGGTTAGT TTTGCAGGTTTGCATCCAGCTGTGTGATAT TCTGCTGTGCAAATCCATGCAAAACTGACT GTGGTAGTGAAAAGTCTGTA | NT_009952.11 | 134 |
| let-7a-2 | TTGTGACTGCATGCTCCCAGGTTGAGGTAG TAGGTTGTATAGTTTAGAATTACATCAAGG GAGATAACTGTACAGCCTCCTAGCTTTCCT TGGGTCTTGCACTAAACAAC | NT_033899.3 | 135 |
| mir-216 | GATGGCTGTGAGTTGGCTTAATCTCAGCTG GCAACTGTGAGATGTTCATACAATCCCTCA CAGTGGTCTCTGGGATTATGCTAAACAGAG CAATTTCCTAGCCCTCACGA | NT_005375.11 | 136 |
| mir-100-1 | AAAGAGAGAAGATATTGAGGCCTGTTGCCA CAAACCCGTAGATCCGAACTTGTGGTATTA GTCCGCACAAGCTTGTATCTATAGGTATGT GTCTGTTAGGCAATCTCACG | NT_033899.3 | 137 |
| mir-100-2 | AAAGAGAGAAGATATTGAGGCCTGTTGCCA CAAACCCGTAGATCCGAACTTGTGGTATTA GTCCGCACAAGCTTGTATCTATAGGTATGT GTCTGTTAGGCAATCTCACG | NT_033899.3 | 137 |
| mir-187 | GGTCGGGCTCACCATGACACAGTGTGAGAC CTCGGGCTACAACACAGGACCCGGGGCGCT GCTCTGACCCCTCGTGTCTTGTGTTGCAGC CGGAGGGACGCAGGTCCGCA | NT_010966.11 | 139 |
| hypothetical miRNA-137 | GTTCAACATAAGCAAACAGATTGTAAACTG GCTGATAATTTTTGTACTGACAATGTCATT TACAGCTGTCAGCCTTTCGTCTGCCTTGTT TGCTTTATTCAAATATGAAC | NT_011387.8 | 140 |
| hypothetical miRNA-138 | CCCTCCAATGTCTGATTAATCAAGCCTGCA AACAGCTTATTTCTTTTAGCCTGCATGCAA GTATGAAAATGACATTCTGGGAGCCGAACA TGGTGCAGATTTGTTCATTC | NT_008902.13 | 141 |
| hypothetical miRNA-139 | CCCCTGCAATGTCTGATTAATCAAGCCTGC AAACAGCTTATTTCTTTTAGCCTGCATGCA AGTATGAAAATGAGATTCTGGGAGCCGAAC ATGGTGCAGATTTGTTCATT | NT_008902.13 | 142 |
| mir-124a-3 | CCCGCCCCAGCCCTGAGGGCCCCTCTGCGT GTTCACAGCGGACCTTGATTTAATGTCTAT ACAATTAAGGCACGCGGTGAATGCCAAGAG AGGCGCCTCCGCCGCTCCTT | NT_011333.5 | 143 |
| mir-7-2 | CTGGATACAGAGTGGACCGGCTGGCCCCAT CTGGAAGACTAGTGATTTTGTTGTTGTCTT ACTGCGCTCAACAACAAATCCCAGTCTACC TAATGGTGGCAGCCATCGCA | NT_033276.3 | 144 |

TABLE 1-continued pri-miRNAs

| pri-miRNA | pri-miRNA sequence | Genbank Accession # of source sequence | SEQ ID NO |
|---|---|---|---|
| hypothetical miRNA-142 | gggGTGAATTTATTTCTTACAGAACCGCCC TGATTCAGATGGTGCAAGCCTCGCAGGCCA GAAACATCTTCCTGACGCTGCTCCCCACCT TCTGCCCTCTCTTTCCCAGC | NT_033317.3 | 145 |
| hypothetical miRNA-143 | GCTGATGAAAATAGGGCAGTGGTTTAAATA GATTTGCAAGCAATTTACCTTTTCACAATG TTGGCAATCTGATGCAATTTGCTTGCAATT TTGTCTGCTTTCAGTAGCAC | NT_007819.11 | 146 |
| hypothetical miRNA-144 | CACGCATGAGCGGACGCTAACCCCCTCCCC AGCCACAAAGAGTCTACATGTCTAGGGTCT AGACATGTTCAGCTTTGTGGACCTCCGGCT CCTGCTCCTCTTAGCGGCCA | NT_010783.11 | 147 |
| mir-210 | ACCCGGCAGTGCCTCCAGGCGCAGGGCAGC CCTGCCCACCGCACACTGCGCTGCCCCAG ACCCACTGTGCGTGTGACAGCGGCTGATCT GTGCCTGGGCAGCGCGACCC | NT_035113.2 | 148 |
| mir-215 | ATCATTCAGAAATGGTATACAGGAAAATGA CCTATGAATTGACAGACAATATAGCTGAGT TTGTCTGTCATTTCTTTAGGCCAATATTCT GTATGACTGTGCTACTTCAA | NT_021953.13 | 149 |
| mir-223 | CCTGGCCTCCTGCAGTGCCACGCTCCGTGT ATTTGACAAGCTGAGTTGGACACTCCATGT GGTAGAGTGTCAGTTTGTCAAATACCCCAA GTGCGGCACATGCTTACCAG | NT_011669.11 | 150 |
| mir-131-3 | CACGGCGCGGCAGCGGCACTGGCTAAGGGA GGCCCGTTTCTCTCTTTGGTTATCTAGCTG TATGAGTGCCACAGAGCCGTCATAAAGCTA gataaccgaaagtagaaatg | NT_033276.3 | 151 |
| mir-199a-1 | TGGATAGCCGGCCCCGCCAACCCAGTGTTC AGACTACCTGTTCAGGAGGCTCTCAATGTG TACAGTAGTCTGCACATTGGTTAGGCTGGG CTTGGGTGAGCGGCTCGTCG | NT_011176.13 | 152 |
| mir-30c | CCTAGAGAGCACTGAGCGACAGATACTGTA AACATCCTACACTCTCAGCTGTGGAAAGTA AGAAAGCTGGGAGAAGGCTGTTTACTCTTT CTGCCTTGGAAGTCAACTAA | NT_007299.11 | 153 |
| mir-101-1 | AGGCTGCCCTGGCTCAGTTATCACAGTGCT GATGCTGTCTATTCTAAAGGTACAGTACTG TGATAACTGAAGGATGGCAGCCATCTTACC TTCCATCAGAGGAGCCTCAC | NT_029865.8 | 154 |
| mir-101-2 | AGGCTGCCCTGGCTCAGTTATCACAGTGCT GATGCTGTCTATTCTAAAGGTACAGTACTG TGATAACTGAAGGATGGCAGCCATCTTACC TTCCATCAGAGGAGCCTCAC | NT_029865.8 | 154 |
| hypothetical miRNA-153 | TGTTGAATGCAAGCAGATGCTGATAATATC AGAAGTCACAGCATAATTTTTTTGATCAA AGGGCTCAAGTGAGCCTGATGAAGCATGCA TCTTGCTCGTCTTTGATAAA | NT_005332.11 | 156 |
| hypothetical miRNA-154 | CCTGCAGTGATGCTTCATGAGCAAATCACA TGATGTCAGAATGGTATGGTTTCGATTTAA TCAAGAAAGAGATTAAAGTGGATGTGTGTT ATTTTCAACTTCGCAGCAGC | NT_030828.7 | 157 |
| mir-26b | CGCCCCACCCTGCCCGGGACCCAGTTCAAG TAATTCAGGATAGGTTGTGTGCTGTCCAGC CTGTTCTCCATTACTTGGCTCGGGGACCGG TGCCCTGCAGCCTTGGGGTG | NT_005403.11 | 158 |

TABLE 1-continued pri-miRNAs

| pri-miRNA | pri-miRNA sequence | Genbank Accession # of source sequence | SEQ ID NO |
|---|---|---|---|
| hypothetical miRNA-156 | TGCGTTTACATAACACCAGGCGTGTGGGAG CTGGAGGAAGAGGTTGCGAATGTAGGAGAG ATAAGGCTCCTGCTTTCCCTCCTTCCTTCT TGGTGGTACCAGGCTTGACA | NT_029289.7 | 159 |
| mir-152 | GGCCCGCTGTCCCCCCCGGCCCAGGTTCTG TGATACACTCCGACTCGGGCTCTGGAGCAG TCAGTGCATGACAGAACTTGGGCCCGGAAG GACCTTCTGCACCCAACGGG | NT_010783.11 | 160 |
| mir-135-1 | CAGCCCCAGGCCTCGCTGTTCTCTATGGCT TTTTATTCCTATGTGATTCTACTGCTCACT CATATAGGGATTGGAGCCGTGGCGCACGGC GGGGACAGCCAGCGGAGGGT | NT_005986.13 | 161 |
| mir-135-2 | ACCAAGATAAATTCACTCTAGTGCTTTATG GCTTTTTATTCCTATGTGATAGTAATAAAG TCTCATGTAGGGATGGAAGCCATGAAATAC ATTGTGAAAAATCATCAACT | NT_009681.13 | 162 |
| mir-217 | AGTATAATTATTACATAGTTTTTGATGTCG CAGATACTGCATCAGGAACTGATTGGATAA GAATCAGTCACCATCAGTTCCTAATGCATT GCCTTCAGCATCTAAACAAG | NT_005375.11 | 163 |
| hypothetical miRNA-161 | CTTGGCCATAAACTTGTAGTCATCCTCTAT CCAATCATATTGTCTTGAGTAATTAAATG ATTAGCTTAATTAGCTTAATTAACTAAATT TGACTACAGGACATGGCCAT | NT_004658.12 | 164 |
| mir-15a-2 | GGCGCGAATGTGTGTTTAAAAAAAATAAAA CCTTGGAGTAAAGTAGCAGCACATAATGGT TTGTGGATTTTGAAAAGGTGCAGGCCATAT TGTGCTGCCTCAAAAATACA | NT_033922.3 | 165 |
| let-7g | TTTGCCTGATTCCAGGCTGAGGTAGTAGTT TGTACAGTTTGAGGGTCTATGATACAACCC GGTACAGGAGATAACTGTACAGGCCACTGC CTTGCCAGGAACAGCGCGCC | NT_005986.13 | 166 |
| hypothetical miRNA-164 | AATTGTCCTTGGTTTTACAATGATAAATGA AAAACATTAAAATTCTCCAACTGAACAGGT ATGCAAGGATTTTTATGTTTTGTTGTTGTT GTTAAAACAGTGAGAGCAAA | NT_010783.11 | 167 |
| mir-33b | GGGGGCCGAGAGAGGCGGGCGGCCCCGCGG TGCATTGCTGTTGCATTGCACGTGTGTGAG GCGGGTGCAGTGCCTCGGCAGTGCAGCCCG GAGCCGGCCCCTGGCACCAC | NT_030843.4 | 168 |
| hypothetical miRNA-166 | GCAGTGGCGCTCAATGCTGTGCACTTCCAG TTGCAGCACCTGTAAGGTTTGTTAAAGGTA AAGGCAGGTCGGGAAAAGGTGCTTCGAGGA AGAGGCCTGGGAGGGGCGA | NT_011588.11 | 169 |
| mir-16-2 | GCAATGTCAGCAGTGCCTTAGCAGCACGTA AATATTGGCGTTAAGATTCTAAAATTATCT CCAGTATTAACTGTGCTGCTGAAGTAAGGT TGACCATACTCTACAGTTGT | NT_033922.3 | 170 |
| hypothetical miRNA-168 | ATGGACAAGATCTATGACGGCCAAGTGGAG GTGACTGGCGATAAATACAATGTGGAAAGT ACTGATGGTCAGCCAGGTGCCTTCACCTGC TGTATGGATGCAGGTCTTGC | NT_011520.8 | 171 |
| hypothetical miRNA-169 | CACTGGAGGCTGTTCTATAAATGATCATTG AAGGGCTGCAAGCTAGCCTATAATTACAGG AAAGAAAGTGGCAGCTCTGGCATTTCATAA CTATGTGTCCTCGAAAAGTG | NT_007933.10 | 172 |

TABLE 1-continued pri-miRNAs

| pri-miRNA | pri-miRNA sequence | Genbank Accession # of source sequence | SEQ ID NO |
|---|---|---|---|
| hypothetical miRNA-170 | GAATGTATGATCTTGCTCTAACACTTGGCCAGAGCTGTGTCACCCACTGCTAGTGCCTGAAGTCGACAGACAATTCTGCCAAGGTAACCGAGAATCATTAAGCATCCTGC | NT_005151.11 | 173 |
| hypothetical miRNA-171 | CACCCTGTCTGACAAGTATGTTTTATCGTTTCAAGAAATGCGGTTAACCTCGCAGTACTAAAACTGAATGAACAAGGCCTGTTGGACAAATTGAAAAACAAATGGTGGTA | NT_006171.13 | 174 |
| hypothetical miRNA-172 | TGTTTTTTTGAGTACATGTGTATAAATAGAGGTGGCTTCCTGTCAGTTTGGTATTATTGATATGATCCAACTGCAAGAAGTTACTGCAACACTTTGCATCTTAAAGGTCC | NT_037752.1 | 175 |
| hypothetical miRNA-173 | TAGTTCAGCACTCTTACCTCTTATTGGTGTACCACCTGGGTGGATAATATGAATGCAAATAAGATTAGAAAGAAGAAGCATTAGTACGAGAAGAAGGAGGCTAGGGCTGG | NT_008413.13 | 176 |
| mir-182 | GAGCTGCTTGCCTCCCCCCGTTTTTGGCAATGGTAGAACTCACACTGGTGAGGTAACAGGATCCGGTGGTTCTAGACTTGCCAACTATGGGGCGAGGACTCAGCCGGCAC | NT_007933.10 | 177 |
| hypothetical miRNA-175 | CTTGCCAGAAACATCAGTGACATGGACAAAGGTGTCATTGAAGGAGACAAAGATGTGGCAGGCACCAAATACATTCTCTCCTTCAACCACCTGAGGTCCGAGGCTGATGA | NT_006258.12 | 178 |
| hypothetical miRNA-176 | TGGAAGGAAAATAGGAGTTTGATATGACATATTGTGTGTCTCAGCAAGACTCATAAATAATTTTGACAAGTTTTTGTATGCATGGGAAAGTCCTTGATTCAGCCTCCCAT | NT_025004.11 | 179 |
| hypothetical miRNA-177 | GGGAACCAGCGCTTTCAGTAAGAGAGTGGTACCACGTGTCTTCAAAATGAAACGTTTGTTGGAGACAAACATGCTACTCTCACTGAGTACACAAGCTTCCTGGTTGTCAG | NT_023098.7 | 180 |
| hypothetical miRNA-178 | CCAGTTTCCATCTGTCATGATAGCCTATCTCCGAACCTTCAATCTGTCAAAAGCTCGCTGCCTGGCTGAAGGCTCCAGGAGATTTGGTGCACTAAACACATTTGACAACA | NT_037537.1 | 181 |
| hypothetical miRNA-179 | AATGCCAGTGAGTTTGAAAGGCACTTTGTCCAATTAGAAGTGTGGAGAAATATTCATCCTGTCCATGACAAAGATGAAGTGCTTCTTTCAAAAGCGGCGGTGGCAGGCTG | NT_010194.13 | 182 |
| hypothetical miRNA-180 | AGCACTTCTACATGATCCTATGACTCTTGATATGGACGCAGTCCTGTCAGACTTTGTTCGGTCCACGGGGCAGAACCTGGTCTGGCCAGAGACCTGCTGGAAGGTAAGC | NT_010363.13 | 183 |
| hypothetical miRNA-181 | TTGTGCACCTCACCTGCTCTGGAAGTAGTTTGCTAGCTCTGATGCTTCATGGTTCAGACTCCTCAGGTGCACGATTAAATTTCCAGAGTTGGTGAACATGGCGCCACATG | NT_033899.3 | 184 |
| mir-148a | GGAGGAAGACAGCACGTTTGGTCTTTTGAGGCAAAGTTCTGAGACACTCGGACTCTGAGTATGATAGAAGTCAGTGCACTACAGAACTTTGTCTCTAGAGGCTGTGGTCG | NT_007819.11 | 185 |
| hypothetical miRNA-183 | ACTCCAGGTGAAACACTGCTGAGTCCTTTGGTGATGTGTGGTCCCCATGGCCTCAAGTTCCTGAAGCCTGTGGAGCTGCGCTTACCACACTGTGCGTCCATGACTCCTGA | NT_010363.13 | 186 |

TABLE 1-continued pri-miRNAs

| pri-miRNA | pri-miRNA sequence | Genbank Accession # of source sequence | SEQ ID NO |
|---|---|---|---|
| mir-23a | CTCACCCCTGTGCCACGGCCGGCTGGGGTT CCTGGGGATGGGATTTGCTTCCTGTCACAA ATCACATTGCCAGGGATTTCCAACCGACCC TGAGCTCTGCCACCGAGGAT | NT_031915.4 | 187 |
| hypothetical miRNA-185 | ACACAAAACATGAACTGTGTACTCATTGTC TTCGCTGCACAGCTTGGCATTGGGGTTGGT GACTCTGATGGCCAGCTGAGCAGCTCTTTC CACAATGGCTTTGTGGTCCT | NT_007592.11 | 188 |
| hypothetical miRNA-186 | ATATGGGAACCAGTGCTTGCAGAAAGAGGG TAGTTCCACATGTCTGCAAAACGAGACATC TCTTGAAGACAAACATGCTACTCTCACTGC GTACATAAGCTTCCTATTTG | NT_008705.13 | 189 |
| mir-181c | CGGAAAATTTGCGAAGGGTTTGGGGGAACA TTCAACCTGTCGGTGAGTTTGGGCAGCTCA GGCAAACCATCGACCGTTGAGTGGACCCTG AGGCCTGGAATTGCCATCCT | NT_031915.4 | 190 |
| hypothetical miRNA-188 | AGAATGGTATCATAGGACAGTGTGATGGAA TTTTTCTTTCTCTGTCATCATTAAGGGGGT TCCCCCTATGGTGAGGGGAATGAAAAGTAC GATTTAATGTTCTCTGGAGA | NT_023148.9 | 191 |

Example 4 miRNAs Within pri-miRNAs miRNAs found within the pri-miRNA structures disclosed above were used in certain embodiments of the present invention. These miRNAs represent target nucleic acids to which the oligomeric compounds of the present invention were designed. The oligomeric compounds of the present invention can also be designed to mimic the miRNA while incorporating certain chemical modifications that alter one or more properties of the mimic, thereby creating a construct with superior properties over the endogenous miRNA. The miRNA target sequences are shown in Table 2.

TABLE 2 miRNAs found within pri-miRNAs

| Pri-miRNA | miRNA sequence (DNA form; where T replaces U in RNA) | SEQ ID NO |
|---|---|---|
| mir-140 | AGTGGTTTTACCCTATGGTAG | 192 |
| mir-30a | CTTTCAGTCGGATGTTTGCAGC | 193 |
| mir-34 | TGGCAGTGTCTTAGCTGGTTGT | 194 |
| mir-29b-1 | TAGCACCATTTGAAATCAGTGTT | 195 |
| mir-29b-2 | TAGCACCATTTGAAATCAGTGTT | 195 |
| mir-16-3 | TAGCAGCACGTAAATATTGGCG | 196 |
| mir-203 | GTGAAATGTTTAGGACCACTAG | 197 |
| mir-7-1 | TGGAAGACTAGTGATTTTGTT | 198 |
| mir-10b | TACCCTGTAGAACCGAATTTGT | 199 |

TABLE 2-continued miRNAs found within pri-miRNAs

| Pri-miRNA | miRNA sequence (DNA form; where T replaces U in RNA) | SEQ ID NO |
|---|---|---|
| mir-128a | TCACAGTGAACCGGTCTCTTTT | 200 |
| mir-153-1 | TTGCATAGTCACAAAAGTGA | 201 |
| mir-153-2 | TTGCATAGTCACAAAAGTGA | 201 |
| mir-27b | TTCACAGTGGCTAAGTTCTG | 202 |
| mir-96 | TTTGGCACTAGCACATTTTGC | 203 |
| mir-17as/ mir-91 | CAAAGTGCTTACAGTGCAGGTAGT | 204 |
| mir-123/ mir-126as | CATTATTACTTTTGGTACGCG | 205 |
| mir-132 | TAACAGTCTACAGCCATGGTCGC | 206 |
| mir-108-1 | ATAAGGATTTTTAGGGCATT | 207 |
| mir-23b | ATCACATTGCCAGGGATTACCAC | 208 |
| let-7i | TGAGGTAGTAGTTTGTGCT | 209 |
| mir-212 | TAACAGTCTCCAGTCACGGCC | 210 |
| mir-131-2 | TAAAGCTAGATAACCGAAAGT | 211 |
| let-7b | TGAGGTAGTAGGTTGTGTGGTT | 212 |
| mir-1d | TGGAATGTAAAGAAGTATGTAT | 213 |
| mir-122a | TGGAGTGTGACAATGGTGTTTGT | 214 |

TABLE 2-continued miRNAs found within pri-miRNAs

| Pri-miRNA | miRNA sequence (DNA form; where T replaces U in RNA) | SEQ ID NO |
|---|---|---|
| mir-22 | AAGCTGCCAGTTGAAGAACTGT | 215 |
| mir-92-1 | TATTGCACTTGTCCCGGCCTGT | 216 |
| mir-142 | CATAAAGTAGAAAGCACTAC | 217 |
| mir-183 | TATGGCACTGGTAGAATTCACTG | 218 |
| mir-214 | ACAGCAGGCACAGACAGGCAG | 219 |
| mir-143 | TGAGATGAAGCACTGTAGCTCA | 220 |
| mir-192-1 | CTGACCTATGAATTGACAGCC | 221 |
| mir-192-2 | CTGACCTATGAATTGACAGCC | 221 |
| mir-192-3 | CTGACCTATGAATTGACAGCC | 221 |
| let-7a-3 | TGAGGTAGTAGGTTGTATAGTT | 222 |
| mir-181a | AACATTCAACGCTGTCGGTGAGT | 223 |
| let-7a-1 | TGAGGTAGTAGGTTGTATAGTT | 222 |
| mir-205 | TCCTTCATTCCACCGGAGTCTG | 224 |
| mir-103-1 | AGCAGCATTGTACAGGGCTATGA | 225 |
| mir-26a | TTCAAGTAATCCAGGATAGGCT | 226 |
| mir-33a | GTGCATTGTAGTTGCATTG | 227 |
| mir-196-2 | TAGGTAGTTTCATGTTGTTGGG | 228 |
| mir-107 | AGCAGCATTGTACAGGGCTATCA | 229 |
| mir-106 | AAAAGTGCTTACAGTGCAGGTAGC | 230 |
| let-7f-i | TGAGGTAGTAGATTGTATAGTT | 231 |
| mir-29c | CTAGCACCATTTGAAATCGGTT | 232 |
| mir-130a | CAGTGCAATGTTAAAAGGGC | 233 |
| mir-218-1 | TTGTGCTTGATCTAACCATGT | 234 |
| mir-124a-2 | TTAAGGCACGCGGTGAATGCCA | 235 |
| mir-21 | TAGCTTATCAGACTGATGTTGA | 236 |
| mir-16-1 | TAGCAGCACGTAAATATTGGCG | 196 |
| mir-144 | TACAGTATAGATGATGTACTAG | 237 |
| mir-221 | AGCTACATTGTCTGCTGGGTTTC | 238 |
| mir-222 | AGCTACATCTGGCTACTGGGTCTC | 239 |
| mir-30d | TGTAAACATCCCCGACTGGAAG | 240 |
| mir-19b-2 | TGTGCAAATCCATGCAAAACTGA | 241 |
| mir-128b | TCACAGTGAACCGGTCTCTTTC | 242 |
| mir-29b-3 | TAGCACCATTTGAAATCAGTGTT | 195 |
| mir-129-2 | CTTTTTGCGGTCTGGGCTTGC | 243 |
| mir-133b | TTGGTCCCCTTCAACCAGCTA | 244 |
| let-7d | AGAGGTAGTAGGTTGCATAGT | 245 |
| mir-15b | TAGCAGCACATCATGGTTTACA | 246 |
| mir-29a-1 | CTAGCACCATCTGAATCGGTT | 247 |
| mir-199b | CCCAGTGTTTAGACTATCTGTTC | 248 |
| mir-129-1 | CTTTTTGCGGTCTGGGCTTGC | 243 |
| let-7e | TGAGGTAGGAGGTTGTATAGT | 249 |
| let-7c | TGAGGTAGTAGGTTGTATGGTT | 250 |
| mir-204 | TTCCCTTTGTCATCCTATGCCT | 251 |
| mir-145 | GTCCAGTTTTCCCAGGAATCCCTT | 252 |
| mir-124a-1 | TTAAGGCACGCGGTGAATGCCA | 235 |
| mir-213 | ACCATCGACCGTTGATTGTACC | 253 |
| mir-20 | TAAAGTGCTTATAGTGCAGGTAG | 254 |
| mir-133a-1 | TTGGTCCCCTTCAACCAGCTGT | 255 |
| mir-138-2 | AGCTGGTGTTGTGAATC | 256 |
| mir-98 | TGAGGTAGTAAGTTGTATTGTT | 257 |
| mir-196-1 | TAGGTAGTTTCATGTTGTTGGG | 228 |
| mir-125b-1 | TCCCTGAGACCCTAACTTGTGA | 258 |
| mir-199a-2 | CCCAGTGTTCAGACTACCTGTTC | 259 |
| mir-29a-2 | CTAGCACCATCTGAAATCGGTT | 247 |
| mir-181b | AACATTCATTGCTGTCGGTGGGTT | 260 |
| mir-141 | AACACTGTCTGGTAAAGATGG | 261 |
| mir-131-1 | TAAAGCTAGATAACCGAAAGT | 211 |
| mir-133a-2 | TTGGTCCCCTTCAACCAGCTGT | 255 |
| mir-1b | TGGAATGTAAAGAAGTATGTAT | 213 |
| mir-18 | TAAGGTGCATCTAGTGCAGATA | 262 |
| mir-220 | CCACACCGTATCTGACACTTT | 263 |
| mir-7-3 | TGGAAGACTAGTGATTTTGTT | 198 |
| mir-218-2 | TTGTGCTTGATCTAACCATGT | 234 |
| mir-24-2 | TGGCTCAGTTCAGCAGGAACAG | 264 |
| mir-24-1 | TGGCTCAGTTCAGCAGGAACAG | 264 |
| mir-103-2 | AGCAGCATTGTACAGGGCTATGA | 225 |
| mir-211 | TTCCCTTTGTCATCCTTCGCCT | 264 |
| mir-101-3 | TACAGTACTGTGATAACTGA | 265 |
| mir-30b | TGTAAACATCCTACACTCAGC | 266 |
| let-7a-4 | TGAGGTAGTAGGTTGTATAGTT | 222 |
| mir-10a | TACCCTGTAGATCCGAATTTGTG | 267 |
| mir-19a | TGTGCAAATCTATGCAAAACTGA | 268 |
| let-7f-2 | TGAGGTAGTAGATTGTATAGTT | 231 |

TABLE 2-continued miRNAs found within pri-miRNAs

| Pri-miRNA | miRNA sequence (DNA form; where T replaces U in RNA) | SEQ ID NO |
|---|---|---|
| mir-15a-1 | TAGCAGCACATAATGGTTTGTG | 269 |
| mir-108-2 | ATAAGGATTTTTAGGGGCATT | 207 |
| mir-137 | TATTGCTTAAGAATACGCGTAG | 270 |
| mir-219 | TGATTGTCCAAACGCAATTCT | 271 |
| mir-148b | TCAGTGCATCACAGAACTTTGT | 272 |
| mir-130b | CAGTGCAATGATGAAAGGGC | 273 |
| mir-19b-1 | TGTGCAAATCCATGCAAAACTGA | 241 |
| let-7a-2 | TGAGGTAGTAGGTTGTATAGTT | 222 |
| mir-216 | TAATCTCAGCTGGCAACTGTG | 274 |
| mir-100-1 | AACCCGTAGATCCGAACTTGTG | 275 |
| mir-100-2 | AACCCGTAGATCCGAACTTGTG | 275 |
| mir-187 | TCGTGTCTTGTGTTGCAGCCGG | 276 |
| mir-124a-3 | TTAAGGCACGCGGTGAATGCCA | 235 |
| mir-7-2 | TGGAAGACTAGTGATTTTGTT | 198 |
| mir-210 | CTGTGCGTGTGACAGCGGCTG | 277 |
| mir-215 | ATGACCTATGAATTGACAGAC | 278 |
| mir-223 | TGTCAGTTTGTCAAATACCCC | 279 |
| mir-131-3 | TAAAGCTAGATAACCGAAAGT | 211 |
| mir-199a-1 | CCCAGTGTTCAGACTACCTGTTC | 259 |
| mir-30c | TGTAAACATCCTACACTCTCAGC | 280 |
| mir-101-1 | TACAGTACTGTGATAACTGA | 265 |
| mir-101-2 | TACAGTACTGTGATAACTGA | 265 |
| mir-26b | TTCAAGTAATTCAGGATAGGTT | 281 |
| mir-152 | TCAGTGCATGACAGAACTTGG | 282 |
| mir-135-1 | TATGGCTTTTTATTCCTATGTGAT | 283 |
| mir-135-2 | TATGGCTTTTTATTCCTATGTGAT | 283 |
| mir-217 | TACTGCATCAGGAACTGATTGGAT | 284 |
| mir-15a-2 | TAGCAGCACATAATGGTTTGTG | 269 |
| let-7g | TGAGGTAGTAGTTTGTACAGT | 285 |
| mir-33b | GTGCATTGCTGTTGCATTG | 286 |
| mir-16-2 | TAGCAGCACGTAAATATTGGCG | 196 |
| mir-182 | TTTGGCAATGGTAGAACTCACA | 287 |
| mir-148a | TCAGTGCACTACAGAACTTTGT | 288 |
| mir-23a | ATCACATTGCCAGGGATTTCC | 289 |
| mir-181c | AACATTCAACCTGTCGGTGAGT | 290 |

Example 5

Uniform 2'-MOE Phosphorothioate (PS) Oligomeric Compounds Targeting miRNAs

In accordance with the present invention, a series of oligomeric compounds were designed and synthesized to target miRNA sequences disclosed by Lim et al. *Science*, 2003, 299, 1540. The compounds are shown in Table 3. "Pri-miRNA" indicates the particular pri-miRNA which contains the miRNA that the oligomeric compound was designed to target. All compounds in Table 3 are composed of 2'-methoxyethoxy (2'-MOE) nucleotides throughout and the internucleoside (backbone) linkages are phosphorothioate (P=S) throughout. All cytidine residues are 5-methylcytidines. The compounds can be analyzed for their effect on miRNA, pre-miRNA or pri-miRNA levels by quantitative real-time PCR as described, supra, or they can be used in other assays to investigate the role of miRNAs or the function of targets downstream of miRNAs.

TABLE 3

Uniform 2'-MOE PS Compounds targeting miRNAs

| ISIS Number | SEQ ID NO | Sequence | Pri-miRNA |
|---|---|---|---|
| 327873 | 291 | CTACCATAGGGTAAAACCACT | mir-140 |
| 327874 | 292 | GCTGCAAACATCCGACTGAAAG | mir-30a |
| 327875 | 293 | ACAACCAGCTAAGACACTGCCA | mir-34 |
| 327876 | 294 | AACACTGATTTCAAATGGTGCTA | mir-29b-1 |
| 327877 | 295 | CGCCAATATTTACGTGCTGCTA | mir-16-3 |
| 327878 | 296 | CTAGTGGTCCTAAACATTTCAC | mir-203 |
| 327879 | 297 | AACAAAATCACTAGTCTTCCA | mir-7-1 |
| 327880 | 298 | ACAAATTCGGTTCTACAGGGTA | mir-10b |
| 327881 | 299 | AAAAGAGACCGGTTCACTGTGA | mir-128a |
| 327882 | 300 | TGACTTTTGTGACTATGCAA | mir-153-1 |
| 327883 | 301 | CAGAACTTAGCCACTGTGAA | mir-27b |
| 327884 | 302 | GCAAAAATGTGCTAGTGCCAAA | mir-96 |
| 327885 | 303 | ACTACCTGCACTGTAAGCACTTTG | mir-17as/mir-91 |
| 327886 | 304 | CGCGTACCAAAAGTAATAATG | mir-123/mir-126as |
| 327887 | 305 | GCGACCATGGCTGTAGACTGTTA | mir-132 |
| 327888 | 306 | AATGCCCCTAAAAATCCTTAT | mir-108-1 |
| 327889 | 307 | GTGGTAATCCCTGGCAATGTGAT | mir-23b |
| 327890 | 308 | AGCACAAACTACTACCTCA | let-7i |
| 327891 | 309 | GGCCGTGACTGGAGACTGTTA | mir-212 |
| 327892 | 310 | ACTTTCGGTTATCTAGCTTTA | mir-131-2/mir-9 |
| 327893 | 311 | AACCACACAACCTACTACCTCA | let-7b |
| 327894 | 312 | ATACATACTTCTTTACATTCCA | mir-id |
| 327895 | 313 | ACAAACACCATTGTCACACTCCA | mir-122a |

TABLE 3-continued

Uniform 2'-MOE PS Compounds targeting miRNAs

| ISIS Number | SEQ ID NO | Sequence | Pri-miRNA |
|---|---|---|---|
| 327896 | 314 | ACAGTTCTTCAACTGGCAGCTT | mir-22 |
| 327897 | 315 | ACAGGCCGGGACAAGTGCAATA | mir-92-1 |
| 327898 | 316 | GTAGTGCTTTCTACTTTATG | mir-142 |
| 327899 | 317 | CAGTGAATTCTACCAGTGCCATA | mir-183 |
| 327900 | 318 | CTGCCTGTCTGTGCCTGCTGT | mir-214 |
| 327901 | 319 | TGAGCTACAGTGCTTCATCTGA | mir-143 |
| 327902 | 320 | GGCTGTCAATTCATAGGTCAG | mir-192-1 |
| 327903 | 321 | AACTATACAACCTACTACCTCA | let-7a-3 |
| 327904 | 322 | ACTCACCGACAGCGTTGAATGTT | mir-181a |
| 327905 | 323 | CAGACTCCGGTGGAATGAAGGA | mir-205 |
| 327906 | 324 | TCATAGCCCTGTACAATGCTGCT | mir-103-1 |
| 327907 | 325 | AGCCTATCCTGGATTACTTGAA | mir-26a |
| 327908 | 326 | CAATGCAACTACAATGCAC | mir-33a |
| 327909 | 327 | CCCAACAACATGAAACTACCTA | mir-196-2 |
| 327910 | 328 | TGATAGCCCTGTACAATGCTGCT | mir-107 |
| 327911 | 329 | GCTACCTGCACTGTAAGCACTTTT | mir-106 |
| 327912 | 330 | AACTATACAATCTACTACCTCA | let-7f-1 |
| 327913 | 331 | AACCGATTTCAAATGGTGCTAG | mir-29c |
| 327914 | 332 | GCCCTTTTAACATTGCACTG | mir-130a |
| 327915 | 333 | ACATGGTTAGATCAAGCACAA | mir-218-1 |
| 327916 | 334 | TGGCATTCACCGCGTGCCTTAA | mir-124a-2 |
| 327917 | 335 | TCAACATCAGTCTGATAAGCTA | mir-21 |
| 327918 | 336 | CTAGTACATCATCTATACTGTA | mir-144 |
| 327919 | 337 | GAAACCCAGCAGACAATGTAGCT | mir-221 |
| 327920 | 338 | GAGACCCAGTAGCCAGATGTAGCT | mir-222 |
| 327921 | 339 | CTTCCAGTCGGGGATGTTTACA | mir-30d |
| 327922 | 340 | TCAGTTTTGCATGGATTTGCACA | mir-19b-2 |
| 327923 | 341 | GAAAGAGACCGGTTCACTGTGA | mir-128b |
| 327924 | 342 | GCAAGCCCAGACCGCAAAAAG | mir-129-2 |
| 327925 | 343 | TAGCTGGTTGAAGGGGACCAA | mir-133b |
| 327926 | 344 | ACTATGCAACCTACTACCTCT | let-7d |
| 327927 | 345 | TGTAAACCATGATGTGCTGCTA | mir-15b |
| 327928 | 346 | AACCGATTTCAGATGGTGCTAG | mir-29a-1 |
| 327929 | 347 | GAACAGATAGTCTAAACACTGGG | mir-199b |
| 327930 | 348 | ACTATACAACCTCCTACCTCA | let-7e |
| 327931 | 349 | AACCATACAACCTACTACCTCA | let-7c |
| 327932 | 350 | AGGCATAGGATGACAAAGGGAA | mir-204 |
| 327933 | 351 | AAGGGATTCCTGGGAAAACTGGAC | mir-145 |
| 327934 | 352 | GGTACAATCAACGGTCGATGGT | mir-213 |
| 327935 | 353 | CTACCTGCACTATAAGCACTTTA | mir-20 |
| 327936 | 354 | ACAGCTGGTTGAAGGGGACCAA | mir-133a-1 |
| 327937 | 355 | GATTCACAACACCAGCT | mir-138-2 |
| 327938 | 356 | AACAATACAACTTACTACCTCA | mir-98 |
| 327939 | 357 | TCACAAGTTAGGGTCTCAGGGA | mir-125b-1 |
| 327940 | 358 | GAACAGGTAGTCTGAACACTGGG | mir-199a-2 |
| 327941 | 359 | AACCCACCGACAGCAATGAATGTT | mir-181b |
| 327942 | 360 | CCATCTTTACCAGACAGTGTT | mir-141 |
| 327943 | 361 | TATCTGCACTAGATGCACCTTA | mir-1B |
| 327944 | 362 | AAAGTGTCAGATACGGTGTGG | mir-220 |
| 327945 | 363 | CTGTTCCTGCTGAACTGAGCCA | mir-24-2 |
| 327946 | 364 | AGGCGAAGGATGACAAAGGGAA | mir-211 |
| 327947 | 365 | TCAGTTATCACAGTACTGTA | mir-101-3 |
| 327948 | 366 | GCTGAGTGTAGGATGTTTACA | mir-30b |
| 327949 | 367 | CACAAATTCGGATCTACAGGGTA | mir-10a |
| 327950 | 368 | TCAGTTTTGCATAGATTTGCACA | mir-19a |
| 327951 | 369 | CACAAACCATTATGTGCTGCTA | mir-15a-1 |
| 327952 | 370 | GTACGCGTATTCTTAAGCAATA | mir-137 |
| 327953 | 371 | AGAATTGCGTTTGGACAATCA | mir-219 |
| 327954 | 372 | ACAAAGTTCTGTGATGCACTGA | mir-148b |
| 327955 | 373 | GCCCTTTCATCATTGCACTG | mir-130b |
| 327956 | 374 | CACAGTTGCCAGCTGAGATTA | mir-216 |
| 327957 | 375 | CACAAGTTCGGATCTACGGGTT | mir-100-1 |
| 327958 | 376 | CCGGCTGCAACACAAGCACGA | mir-187 |
| 327959 | 377 | CAGCCGCTGTCACACGCACAG | mir-210 |
| 327960 | 378 | GTCTGTCAATTCATAGGTCAT | mir-215 |
| 327961 | 379 | GGGGTATTTGACAAACTGACA | mir-223 |
| 327962 | 380 | GCTGAGAGTGTAGGATGTTTACA | mir-30c |
| 327963 | 381 | AACCTATCCTGAATTACTTGAA | mir-26b |
| 327964 | 382 | CCAAGTTCTCTCATGCACTGA | mir-152 |
| 327965 | 383 | ATCAGATAGGAATAAAAAGCCATA | mir-135-1 |
| 327966 | 384 | ATCCAATCAGTTCCTGATGCAGTA | mir-217 |
| 327967 | 385 | ACTGTACAAACTACTACCTCA | let-7g |
| 327968 | 386 | CAATGCAACAGCAATGCAC | mir-33b |
| 327969 | 387 | TGTGAGTTCTACCATTGCCAAA | mir-182 |

TABLE 3-continued

Uniform 2'-MOE PS Compounds targeting miRNAs

| ISIS Number | SEQ ID NO | Sequence | Pri-miRNA |
|---|---|---|---|
| 327970 | 388 | ACAAAGTTCTGTAGTGCACTGA | mir-148a |
| 327971 | 389 | GGAAATCCCTGGCAATGTGAT | mir-23a |
| 327972 | 390 | ACTCACCGACAGGTTGAATGTT | mir-181c |

Example 6

Uniform 2'-MOE Phosphorothioate (PS) Oligomeric Compounds Targeting Novel miNAs

In accordance with the present invention, a series of oligomeric compounds were designed and synthesized to target novel miRNAs. The compounds are shown in Table 4. "Pri-miRNA" indicates the particular pri-miRNA defined herein which contains the miRNA that the oligomeric compound was designed to target. The sequence of the compounds represent the full complement of the novel miRNA defined herein. All compounds in Table 4 are composed of 2'-methoxyethoxy (2'-MOE) nucleotides throughout and the internucleoside (backbone) linkages are phosphorothioate (P=S) throughout. All cytidine residues are 5-methylcytidines. The compounds can be analyzed for their effect miRNA, pre-miRNA or pri-mRNA levels by quantitative real-time PCR as described, supra, or they can be used in other assays to investigate the role of miRNAs or downstream targets of miRNAs.

TABLE 4

Uniform 2'-MOE PS Compounds targeting novel pri-miRNAs

| ISIS Number | SEQ ID NO | Sequence (5'-3') | Pri-miRNA |
|---|---|---|---|
| 328089 | 391 | ACTGTAGGAATATGTTTGATA | hypothetical miRNA-013 |
| 328090 | 392 | ATTAAAAAGTCCTCTTGCCCA | hypothetical miRNA-023 |
| 328091 | 393 | GCTGCCGTATATGTGATGTCA | hypothetical miRNA-030 |
| 328092 | 394 | GGTAGGTGGAATACTATAACA | hypothetical miRNA-033 |
| 328093 | 395 | TAAACATCACTGCAAGTCTTA | hypothetical miRNA-039 |
| 328094 | 396 | TTGTAAGCAGTTTTGTTGACA | hypothetical miRNA-040 |
| 328095 | 397 | TCACAGAGAAAACAACTGGTA | hypothetical miRNA-041 |
| 328096 | 398 | CCTCTCAAAGATTTCCTGTCA | hypothetical miRNA-043 |
| 328097 | 399 | TGTCAGATAAACAGAGTGGAA | hypothetical miRNA-044 |
| 328098 | 400 | GAGAATCAATAGGGCATGCAA | hypothetical miRNA-055 |

TABLE 4-continued

Uniform 2'-MOE PS Compounds targeting novel pri-miRNAs

| ISIS Number | SEQ ID NO | Sequence (5'-3') | Pri-miRNA |
|---|---|---|---|
| 328099 | 401 | AAGAACATTAAGCATCTGACA | hypothetical miRNA-058 |
| 328100 | 402 | AATCTCTGCAGGCAAATGTGA | hypothetical miRNA-070 |
| 328101 | 403 | AAACCCCTATCACGATTAGCA | hypothetical miRNA-071 |
| 328102 | 404 | GCCCGATTAATATTTTAACCA | hypothetical miRNA-075 |
| 328103 | 405 | CCCAATATCAAACATATCA | hypothetical miRNA-079 |
| 328104 | 406 | TATbATAGCTTCCCCATGTAA | hypothetical miRNA-083 |
| 328105 | 407 | CCTCAATTATTGGAAATCACA | hypothetical miRNA-088 |
| 328106 | 408 | ATTGATGCGCCATTTGGCCTA | hypothetical miRNA-090 |
| 328107 | 409 | CTGTGACTTCTCTATCTGCCT | hypothetical miRNA-099 |
| 328108 | 410 | AAACTTGTTAATTGACTGTCA | hypothetical miRNA-101 |
| 328109 | 411 | AAAGAAGTATATGCATAGGAA | hypothetical miRNA-105 |
| 328110 | 412 | GATAAAGCCAATAAACTGTCA | hypothetical miRNA-107 |
| 328111 | 413 | TCCGAGTCGGAGGAGGAGGAA | hypothetical miRNA-111 |
| 328112 | 414 | ATCATTACTGGATTGCTGTAA | hypothetical miRNA-120 |
| 328113 | 415 | CAAAAATTATCAGCCAGTTTA | hypothetical miRNA-137 |
| 328114 | 416 | AATCTCATTTTCATACTTGCA | hypothetical miRNA-138 |
| 328115 | 417 | AGAAGGTGGGAGCAGCGTCA | hypothetical miRNA-142 |
| 328116 | 418 | CAAAATTGCAAGCAAATTGCA | hypothetical miRNA-143 |
| 328117 | 419 | TCCACAAAGCTGAACATGTCT | hypothetical miRNA-144 |
| 328118 | 420 | TATTATCAGCATCTGCTTGCA | hypothetical miRNA-153 |
| 328119 | 421 | AATAACACACATCCACTTTAA | hypothetical miRNA-154 |
| 328120 | 422 | AAGAAGGAAGGAGGGAAAGCA | hypothetical miRNA-156 |
| 328121 | 423 | ATGACTACAAGTTTATGGCCA | hypothetical miRNA-161 |
| 328122 | 424 | CAAAACATAAAAATCCTTGCA | hypothetical miRNA-164 |

TABLE 4-continued

Uniform 2'-MOE PS Compounds targeting novel pri-miRNAs

| ISIS Number | SEQ ID NO | Sequence (5'-3') | Pri-miRNA |
|---|---|---|---|
| 328123 | 425 | TTACAGGTGCTGCAACTGGAA | hypothetical miRNA-166 |
| 328124 | 426 | AGCAGGTGAAGGCACCTGGCT | hypothetical miRNA-168 |
| 328125 | 427 | TATGAAATGCCAGAGCTGCCA | hypothetical miRNA-169 |
| 328126 | 428 | CCAAGTGTTAGAGCAAGATCA | hypothetical miRNA-170 |
| 328127 | 429 | AACGATAAAACATACTTGTCA | hypothetical miRNA-171 |
| 328128 | 430 | AGTAACTTCTTGCAGTTGGA | hypothetical miRNA-172 |
| 328129 | 431 | AGCCTCCTTCTTCTCGTACTA | hypothetical miRNA-173 |
| 328130 | 432 | ACCTCAGGTGGTTGAAGGAGA | hypothetical miRNA-175 |
| 328131 | 433 | ATATGTCATATCAAACTCCTA | hypothetical miRNA-176 |
| 328132 | 434 | GTGAGAGTAGCATGTTTGTCT | hypothetical miRNA-177 |
| 328133 | 435 | TGAAGGTTCGGAGATAGGCTA | hypothetical miRNA-178 |
| 328134 | 436 | AATTGGACAAAGTGCCTTTCA | hypothetical miRNA-179 |
| 328135 | 437 | ACCGAACAAAGTCTGACAGGA | hypothetical miRNA-180 |
| 328136 | 438 | AACTACTTCCAGAGCAGGTGA | hypothetical miRNA-181 |
| 328137 | 439 | GTAAGCGCAGCTCCACAGGCT | hypothetical miRNA-183 |
| 328138 | 440 | GAGCTGCTCAGCTGGCGATCA | hypothetical miRNA-185 |
| 328139 | 441 | TACTTTTCATTCCCCTCACCA | hypothetical miRNA-188 |

Example 7

Chimeric Phosphorothioate Compounds Having 2'-MOE Wings and a Deoxy Gap Targeting pri-miRNAs In accordance with the present invention, a series of oligomeric compounds were designed and synthesized to target different regions of pri-miRNA structures. The compounds are shown in Table 5. "Pri-miRNA" indicates the particular pri-miRNA which contains the miRNA that the oligomeric compound was designed to target. All compounds in Table 5 are chimeric oligonucleotides ("gapmers") 20 nucleotides in length, composed of a central "gap" region consisting of ten 2'-deoxynucleotides, which is flanked on both sides (5' and 3' directions) by five-nucleotide "wings." The wings are composed of 2'-methoxyethoxy (2'-MOE) nucleotides. The internucleoside (backbone) linkages are phosphorothioate (P=S) throughout the oligonucleotide. All cytidine residues are 5-methylcytidines. The compounds can be analyzed for their effect on miRNA, pre-miRNA or pri-miRNA levels by quantitative real-time PCR as described, supra, or they can be used in other assays to investigate the role of miRNAs or miRNA downstream targets.

TABLE 5

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328333 | 442 | AGAACAGCATGACGTAACCT | mir-140 |
| 328334 | 443 | GCCCATCTGTGGCTTCACAG | mir-30a |
| 328335 | 444 | GAAGTCCGAGGCAGTAGGCA | mir-30a |
| 328336 | 445 | CTTCCTTACTATTGCTCACA | mir-34 |
| 328337 | 446 | GCTAGATACAAAGATGGAAA | mir-29b-1 |
| 328338 | 447 | CTAGACAATCACTATTTAAA | mir-29b-2 |
| 328339 | 448 | GCAGCGCAGCTGGTCTCCCC | mir-29b-2 |
| 328340 | 449 | TAATATATATTTCACTACGC | mir-16-3 |
| 328341 | 450 | TGCTGTATCCCTGTCACACT | mir-16-3 |
| 328342 | 451 | CAATTGCGCTACAGAACTGT | mir-203 |
| 328343 | 452 | TCGATTTAGTTATCTAAAAA | mir-7-1 |
| 328344 | 453 | CTGTAGAGGGATGGCCTGTG | mir-7-1 |
| 328345 | 454 | TGACTATACGGATACCACAC | mir-10b |
| 328346 | 455 | GGAACAAGGCCAATTATTGC | mir-128a |
| 328347 | 456 | AGAAATGTAAACCTCTCAGA | mir-128a |
| 328348 | 457 | AGCTGTGAGGGAGAGAGAGA | mir-153-1 |
| 328349 | 458 | CTGGAGTGAGAATACTAGCT | mir-153-1 |
| 328350 | 459 | ACTGGGCTCATATTAGTAGC | mir-153-2 |
| 328351 | 460 | TTGGATTAAATAACAACCTA | hypothetical miRNA-013 |
| 328352 | 461 | CCCGGAGACAGGGCAAGACA | hypothetical miRNA-013 |
| 328353 | 462 | AAAGCGGAAACCAATCACTG | mir-27b |
| 328354 | 463 | GTCCCCATCTCACCTTCTCT | mir-27b |
| 328355 | 464 | TCAGAGCGGAGAGACACAAG | mir-96 |
| 328356 | 465 | TAGATGCACATATCACTACC | mir-17as/mir-91 |
| 328357 | 466 | CTTGGCTTCCCGAGGCAGCT | mir-17as/mir-91 |
| 328358 | 467 | AGTTTGAAGTGTCACAGCGC | mir-123/mir-126as |
| 328359 | 468 | GCGTTTTCGATGCGGTGCCG | mir-123/mir-126as |
| 328360 | 469 | GAGACGCGGGGCGGGGCGC | mir-132 |

TABLE 5-continued

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328361 | 470 | TACCTCCAGTTCCCACAGTA | mir-132 |
| 328362 | 471 | TGTGTTTTCTGACTCAGTCA | mir-108-1 |
| 328363 | 472 | AGAGCACCTGAGAGCAGCGC | mir-23b |
| 328364 | 473 | TCTTAAGTCACAAATCAGCA | mir-23b |
| 328365 | 474 | TCTCCACAGCGGGCAATGTC | let-7i |
| 328366 | 475 | GGCGCGCTGTCCGGGCGGGG | mir-212 |
| 328367 | 476 | ACTGAGGGCGGCCCGGGCAG | mir-212 |
| 328368 | 477 | GTCCTCTTGCCCAAGCAACA | hypothetical miRNA-023 |
| 328369 | 478 | GAAGACCAATACACTCATAC | mir-131-2 |
| 328370 | 479 | CCGAGGGGCAACATCACTGC | let-7b |
| 328371 | 480 | TCCATAGCTTAGCAGGTCCA | mir-1d |
| 328372 | 481 | TTTGATAGTTTAGACACAAA | mir-122a |
| 328373 | 482 | GGGAAGGATTGCCTAGCAGT | mir-122a |
| 328374 | 483 | AGCTTTAGCTGGGTCAGGAC | mir-22 |
| 328375 | 484 | TACCATACAGAAACACAGCA | mir-92-1 |
| 328376 | 485 | TCACAATCGCCACCAAACTC | mir-92-1 |
| 328377 | 486 | TCACTCCTAAAGGTTCAAGT | hypothetical miRNA-030 |
| 328378 | 487 | CACCCTCCAGTGCTGTTAGT | mir-142 |
| 328379 | 488 | CTGACTGAGACTGTTCACAG | mir-183 |
| 328380 | 489 | CCTTTAGGGGTTGCCACACC | hypothetical miRNA-033 |
| 328381 | 490 | ACAGGTGAGCGGATGTTCTG | mir-214 |
| 328382 | 491 | CAGACTCCCAACTGACCAGA | mir-143 |
| 328383 | 492 | AGAGGGGAGACGAGAGCACT | mir-192-1 |
| 328384 | 493 | TCACGTGGAGAGGAGTTAAA | hypothetical miRNA-039 |
| 328385 | 494 | AGTGCTAATACTTCTTTCAT | hypothetical miRNA-040 |
| 328386 | 495 | ACCTGTGTAACAGCCGTGTA | hypothetical miRNA-041 |
| 328387 | 496 | TTATCGGAACTTCACAGAGA | hypothetical miRNA-041 |
| 328388 | 497 | TCCCATAGCAGGGCAGAGCC | let-7a-3 |
| 328389 | 498 | GGCACTTCATTGCTGCTGCC | hypothetical miRNA-043 |
| 328390 | 499 | GGAGCCTTGCGCTCAGCATT | hypothetical miRNA-043 |
| 328391 | 500 | ATGGTAATTTCATTTCAGGC | hypothetical miRNA-044 |
| 328392 | 501 | GATTGCACATCCACACTGTC | hypothetical miRNA-044 |
| 328393 | 502 | GCTGGCCTGATAGCCCTTCT | mir-181a |
| 328394 | 503 | GTTTTTTCAAATCCCAAACT | mir-181a |
| 328395 | 504 | CCCAGTGGTGGGTGTGACCC | let-7a-1 |
| 328396 | 505 | GTGGTTGGGTATGAGACAGA | mir-205 |
| 328397 | 506 | TTGATCCATATGCAACAAGG | mir-103-1 |
| 328398 | 507 | GCCATTGGGACCTGCACAGC | mir-26a |
| 328399 | 508 | ATGGGTACCACCAGAACATG | mir-33a |
| 328400 | 509 | AGTTCAAAACTCAATCCCAA | mir-196-2 |
| 328401 | 510 | GCCCTCGACGAAAACCGACT | mir-196-2 |
| 328402 | 511 | TTGAACTCCATGCCACAAGG | mir-107 |
| 328403 | 512 | AGGCCTATTCCTGTAGCAAA | mir-106 |
| 328404 | 513 | GTAGATCTCAAAAAGCTACC | mir-106 |
| 328405 | 514 | CTGAACAGGGTAAAATCACT | let-7f-1 |
| 328406 | 515 | AGCAAGTCTACTCCTCAGGG | let-7f-1 |
| 328407 | 516 | AATGGAGCCAAGGTGCTGCC | hypothetical miRNA-055 |
| 328408 | 517 | TAGACAAAAACAGACTCTGA | mir-29c |
| 328409 | 518 | GCTAGTGACAGGTGCAGACA | mir-130a |
| 328410 | 519 | GGGCCTATCCAAAGTGACAG | hypothetical miRNA-058 |
| 328411 | 520 | TACCTCTGCAGTATTCTACA | hypothetical miRNA-058 |
| 328412 | 521 | TTTACTCATACCTCGCAACC | mir-218-1 |
| 328413 | 522 | AATTGTATGACATTAAATCA | mir-124a-2 |
| 328414 | 523 | CTTCAAGTCAGCCGTAGGC | mir-124a-2 |
| 328415 | 524 | TGCCATGAGATTCAACAGTC | mir-21 |
| 328416 | 525 | ACATTGCTATCATAAGAGCT | mir-16-1 |
| 328417 | 526 | TAATTTTAGAATCTTAACGC | mir-16-1 |
| 328418 | 527 | AGTGTCTCATCGCAAACTTA | mir-144 |
| 328419 | 528 | TGTTGCCTAACGAACACAGA | mir-221 |
| 328420 | 529 | GCTGATTACGAAAGACAGGA | mir-222 |
| 328421 | 530 | GCTTAGCTGTGTCTTACAGC | mir-30d |
| 328422 | 531 | GAGGATGTCTGTGAATAGCC | mir-30d |
| 328423 | 532 | CCACATATACATATATACGC | mir-19b-2 |
| 328424 | 533 | AGGAAGCACACATTATCACA | mir-19b-2 |
| 328425 | 534 | GACCTGCTACTCACTCTCGT | mir-128b |

TABLE 5-continued

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328426 | 535 | GGTTGGCCGCAGACTCGTAC | hypothetical miRNA-069 |
| 328427 | 536 | GATGTCACTGAGGAAATCAC | hypothetical miRNA-070 |
| 328428 | 537 | TCAGTTGGAGGCAAAAACCC | hypothetical miRNA-071 |
| 328429 | 538 | GGTAGTGCAGCGCAGCTGGT | mir-29b-3 |
| 328430 | 539 | CCGGCTATTGAGTTATGTAC | mir-129-2 |
| 328431 | 540 | ACCTCTCAGGAAGACGGACT | mir-133b |
| 328432 | 541 | GAGCATGCAACACTCTGTGG | hypothetical miRNA-075 |
| 328433 | 542 | CCTCCTTGTGGGCAAAATCC | let-7d |
| 328434 | 543 | CGCATCTTGACTGTAGCATG | mir-15b |
| 328435 | 544 | TCTAAGGGGTCACAGAAGGT | mir-29a-1 |
| 328436 | 545 | GAAAATTATATTGACTCTGA | mir-29a-1 |

Example 8

Chimeric Phosphorothioate Compounds Having 2'-MOE Wings and a Deoxy Gap Targeting pri-miRNAs In accordance with the present invention, a second series of oligomeric compounds were designed and synthesized to target different regions of pri-miRNA structures. The compounds are shown in Table 6. "Pri-miRNA" indicates the particular pri-miRNA which contain the miRNA that the oligomeric compound was designed to target. All compounds in Table 6 are chimeric oligonucleotides ("gapmers") 20 nucleotides in length, composed of a central "gap" region consisting of ten 2'-deoxynucleotides, which is flanked on both sides (5' and 3' directions) by five-nucleotide "wings." The wings are composed of 2'-methoxyethoxy (2'-MOE) nucleotides. The internucleoside (backbone) linkages are phosphorothioate (P=S) throughout the oligonucleotide. All cytidine residues are 5-methylcytidines. The compounds can be analyzed for their effect on miRNA, pre-miRNA or pri-miRNA levels by quantitative real-time PCR as described, supra, or they can be used in other assays to investigate the role of miRNAs or miRNA downstream targets.

TABLE 6

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328637 | 546 | GGTTCCTAATTAAACAACCC | hypothetical miRNA-079 |
| 328638 | 547 | CCGAGGGTCTAACCCAGCCC | mir-199b |
| 328639 | 548 | GACTACTGTTGAGAGGAACA | mir-129-1 |
| 328640 | 549 | TCTCCTTGGGTGTCCTCCTC | let-7e |
| 328641 | 550 | TGCTGACTGCTCGCGCTTGC | hypothetical miRNA-083 |
| 328642 | 551 | ACTCCCAGGGTGTAACTCTA | let-7c |
| 328643 | 552 | CATGAAGAAAGACTGTAGCC | mir-204 |
| 328644 | 553 | GACAAGGTGGGAGCGAGTGG | mir-145 |
| 328645 | 554 | TGCTCAGCCAGCCCCATTCT | mir-124a-1 |
| 328646 | 555 | GCTTTTAGAACCACTGCCTC | hypothetical miRNA-088 |
| 328647 | 556 | GGAGTAGATGATGGTTAGCC | mir-213 |
| 328648 | 557 | ACTGATTCAAGAGCTTTGTA | hypothetical miRNA-090 |
| 328649 | 558 | GTAGATAACTAAACACTACC | mir-20 |
| 328650 | 559 | AATCCATTGAAGAGGCGATT | mir-133a-1 |
| 328651 | 560 | GGTAAGAGGATGCGCTGCTC | mir-138-2 |
| 328652 | 561 | GGCCTAATATCCCTACCCCA | mir-98 |
| 328653 | 562 | GTGTTCAGAAACCCAGGCCC | mir-196-1 |
| 328654 | 563 | TCCAGGATGCAAAAGCACGA | mir-125b-1 |
| 328655 | 564 | TACAACGGCATTGTCCTGAA | mir-199a-2 |
| 328656 | 565 | TTTCAGGCTCACCTCCCCAG | hypothetical miRNA-099 |
| 328657 | 566 | AAAAATAATCTCTGCACAGG | mir-181b |
| 328658 | 567 | AGAATGAGTTGACATACCAA | hypothetical miRNA-101 |
| 328659 | 568 | GCTTCACAATTAGACCATCC | mir-141 |
| 328660 | 569 | AGACTCCACACCACTCATAC | mir-131-1 |
| 328661 | 570 | ATCCATTGGACAGTGGATTT | mir-133a-2 |
| 328662 | 571 | GGCGGGCGGCTCTGAGGCGG | hypothetical miRNA-105 |
| 328663 | 572 | CTCTTTAGGCCAGATCCTCA | hypothetical miRNA-106 |
| 328664 | 573 | TAATGGTATGTGTGGTGATA | hypothetical miRNA-107 |
| 328665 | 574 | ATTACTAAGTTGTTAGCTGT | mir-1b |
| 328666 | 575 | GATGCTAATCTACTTCACTA | mir-18 |
| 328667 | 576 | TCAGCATGGTGCCCTCGCCC | mir-220 |
| 328668 | 577 | TCCGCGGGGCGGGGAGGCT | hypothetical miRNA-111 |
| 328669 | 578 | AGACCACAGCCACTCTAATC | mir-7-3 |

TABLE 6-continued

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328670 | 579 | TCCGTTTCCATCGTTCCACC | mir-218-2 |
| 328671 | 580 | GCCAGTGTACACAAACCAAC | mir-24-2 |
| 328672 | 581 | AAGGCTTTTTGCTCAAGGGC | mir-24-1 |
| 328673 | 582 | TTGACCTGAATGCTACAAGG | mir-103-2 |
| 328674 | 583 | TGCCCTGCTCAGAGCCCTAG | mir-211 |
| 328675 | 584 | TCAATGTGATGGCACCACCA | mir-101-3 |
| 328676 | 585 | ACCTCCCAGCCAATCCATGT | mir-30b |
| 328677 | 586 | TCCTGGATGATATCTACCTC | hypothetical miRNA-120 |
| 328678 | 587 | TCTCCCTTGATGTAATTCTA | let-7a-4 |
| 328679 | 588 | AGAGCGGAGTGTTTATGTCA | mir-10a |
| 328680 | 589 | TCATTCATTTGAAGGAAATA | mir-19a |
| 328681 | 590 | TCCAAGATGGGGTATGACCC | let-7f-2 |
| 328682 | 591 | TTTTTAAACACACATTCGCG | mir-15a-1 |
| 328683 | 592 | AGATGTGTTTCCATTCCACT | mir-108-2 |
| 328684 | 593 | CCCCCTGCCGCTGGTACTCT | mir-137 |
| 328685 | 594 | CGGCCGGAGCCATAGACTCG | mir-219 |
| 328686 | 595 | CTTTCAGAGAGCCACAGCCT | mir-148b |
| 328687 | 596 | GCTTCCCAGCGGCCTATAGT | mir-130b |
| 328688 | 597 | CAGCAGAATATCACACAGCT | mir-19b-1 |
| 328689 | 598 | TACAATTTGGGAGTCCTGAA | mir-199b |
| 328690 | 599 | GCCTCCTTCATATATTCTCA | mir-204 |
| 328691 | 600 | CCCCATCTTAGCATCTAAGG | mir-145 |
| 328692 | 601 | TTGTATGGACATTTAAATCA | mir-124a-1 |
| 328693 | 602 | TTTGATTTTAATTCCAAACT | mir-213 |
| 328694 | 603 | CAAACGGTAAGATTTGCAGA | hypothetical miRNA-090 |
| 328695 | 604 | GGATTTAAACGGTAAACATC | mir-125b-1 |
| 328696 | 605 | CTCTAGCTCCCTCACCAGTG | hypothetical miRNA-099 |
| 328697 | 606 | GCTTGTCCACACAGTTCAAC | mir-181b |
| 328698 | 607 | GCATTGTATGTTCATATGGG | mir-1b |
| 328699 | 608 | TGTCGTAGTACATCAGAACA | mir-7-3 |
| 328700 | 609 | AGCCAGTGTGTAAAATGAGA | mir-24-1 |
| 328701 | 610 | TTCAGATATACAGCATCGGT | mir-101-3 |
| 328702 | 611 | TGACCACAAAATTCCTTACA | mir-10a |
| 328703 | 612 | ACAACTACATTCTTGTTGTA | mir-19a |
| 328704 | 613 | TGCACCTTTTCAAAATCCAC | mir-15a-1 |
| 328705 | 614 | AACGTAATCCGTATTATCCA | mir-137 |

Example 9

Chimeric Phosphorothioate Compounds Having 2'-MOE Wings and a Deoxy Gap Targeting pri-miRNAs In accordance with the present invention, a third series of oligomeric compounds were designed and synthesized to target different pri-miRNA structures. The compounds are shown in Table 7. "Pri-miRNA" indicates the particular pri-miRNA which contains the miRNA that the oligomeric compound was designed to target. All compounds in Table 7 are chimeric oligonucleotides ("gapmers") 20 nucleotides in length, composed of a central "gap" region consisting of ten 2'-deoxynucleotides, which is flanked on both sides (5' and 3' directions) by five-nucleotide "wings." The wings are composed of 2'-methoxyethoxy (2'-MOE) nucleotides. The internucleoside (backbone) linkages are phosphorothioate (P=S) throughout the oligonucleotide. All cytidine residues are 5-methylcytidines. The compounds can be analyzed for their effect on miRNA, pre-miRNA or pri-miRNA levels by quantitative real-time PCR as described, supra, or they can be used in other assays to investigate the role of miRNAs or miRNA downstream targets.

TABLE 7

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328706 | 615 | CGTGAGGGCTAGGAAATTGC | mir-216 |
| 328707 | 616 | GCAACAGGCCTCAATATCTT | mir-100-1 |
| 328708 | 617 | ACGAGGGGTCAGAGCAGCGC | mir-187 |
| 328709 | 618 | GGCAGACGAAAGGCTGACAG | hypothetical miRNA-137 |
| 328710 | 619 | CTGCACCATGTTCGGCTCCC | hypothetical miRNA-138 |
| 328711 | 620 | GGGGCCCTCAGGGCTGGGGC | mir-124a-3 |
| 328712 | 621 | CCGGTCCACTCTGTATCCAG | mir-7-2 |
| 328713 | 622 | GCTGGGAAAGAGAGGGCAGA | hypothetical miRNA-142 |
| 328714 | 623 | TCAGATTGCCAACATTGTGA | hypothetical miRNA-143 |
| 328715 | 624 | CTGGGGAGGGGGTTAGCGTC | hypothetical miRNA-144 |

TABLE 7-continued

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328716 | 625 | TGGGTCTGGGGCAGCGCAGT | mir-210 |
| 328717 | 626 | TTGAAGTAGCACAGTCATAC | mir-215 |
| 328718 | 627 | TCTACCACATGGAGTGTCCA | mir-124a-3 |
| 328719 | 628 | AGTGCCGCTGCCGCGCCGTG | mir-7-2 |
| 328720 | 629 | ACACATTGAGAGCCTCCTGA | hypothetical miRNA-142 |
| 328721 | 630 | GTCGCTCAGTGCTCTCTAGG | hypothetical miRNA-143 |
| 328722 | 631 | AGGCTCCTCTGATGGAAGGT | hypothetical miRNA-144 |
| 328723 | 632 | GCTGTGACTTCTGATATTAT | hypothetical miRNA-153 |
| 328724 | 633 | GACATCATGTGATTTGCTCA | hypothetical miRNA-154 |
| 328725 | 634 | CACCCCAAGGCTGCAGGGCA | mir-26b |
| 328726 | 635 | TGTCAAGCCTGGTACCACCA | hypothetical miRNA-156 |
| 328727 | 636 | CTGCTCCAGAGCCCGAGTCG | mir-152 |
| 328728 | 637 | ACCCTCCGCTGGCTGTCCCC | mir-135-1 |
| 328729 | 638 | TAGAGTGAATTTATCTTGGT | mir-135-2 |
| 328730 | 639 | TGGTGACTGATTCTTATCCA | mir-217 |
| 328731 | 640 | CAATATGATTGGATAGAGGA | hypothetical miRNA-161 |
| 328732 | 641 | TTTAAACACACATTCGCGCC | mir-15a-2 |
| 328733 | 642 | ACCGGGTGGTATCATAGACC | let-7g |
| 328734 | 643 | TGCATACCTGTTCAGTTGGA | hypothetical miRNA-164 |
| 328735 | 644 | GCCCGCCTCTCTCGGCCCCC | mir-33b |
| 328736 | 645 | TCGCCCCTCCCAGGCCTCT | hypothetical miRNA-166 |
| 328737 | 646 | ACAACTGTAGAGTATGGTCA | mir-16-2 |
| 328738 | 647 | GCTGACCATCAGTACTTTCC | hypothetical miRNA-168 |
| 328739 | 648 | TTATAGAACAGCCTCCAGTG | hypothetical miRNA-169 |
| 328740 | 649 | TTCAGGCACTAGCAGTGGGT | hypothetical miRNA-170 |
| 328741 | 650 | AGTACTGCGAGGTTAACCGC | hypothetical miRNA-171 |
| 328742 | 651 | GGACCTTTAAGATGCAAAGT | hypothetical miRNA-172 |
| 328743 | 652 | TTCATATTATCCACCCAGGT | hypothetical miRNA-173 |
| 328744 | 653 | CGGATCCTGTTACCTCACCA | mir-182 |
| 328745 | 654 | TGGTGCCTGCCACATCTTTG | hypothetical miRNA-175 |
| 328746 | 655 | TGGGAGGCTGAATCAAGGAC | hypothetical miRNA-176 |
| 328747 | 656 | TGACAACCAGGAAGCTTGTG | hypothetical miRNA-177 |
| 328748 | 657 | GGCAGGCAGCGAGCTTTTGA | hypothetical miRNA-178 |
| 328749 | 658 | CAGCCTGCCACCGCCGCTTT | hypothetical miRNA-179 |
| 328750 | 659 | CTGCCCCGTGGACCGAACA | hypothetical miRNA-180 |
| 328751 | 660 | TCGTGCACCTGAGGAGTCTG | hypothetical miRNA-181 |
| 328752 | 661 | CAAACGTGCTGTCTTCCTCC | mir-148a |
| 328753 | 662 | AAGGACTCAGCAGTGTTTCA | hypothetical miRNA-183 |
| 328754 | 663 | TCCTCGGTGGCAGAGCTCAG | mir-23a |
| 328755 | 664 | AGACAATGAGTACACAGTTC | hypothetical miRNA-185 |
| 328756 | 665 | CTGCAAGCACTGGTTCCCAT | hypothetical miRNA-186 |
| 328757 | 666 | TTGCCTGAGCTGCCCAAACT | mir-181c |
| 328758 | 667 | TCCATCACACTGTCCTATGA | hypothetical miRNA-188 |
| 328759 | 668 | GAGGGATTGTATGAACATCT | mir-216 |
| 328760 | 669 | GCTTGTGCGGAGTAATACCA | mir-100-1 |
| 328761 | 670 | GCAGGCTAAAAGAAATAAGC | hypothetical miRNA-138 |
| 328762 | 671 | ATTGTATAGACATTAAATCA | mir-124a-3 |
| 328763 | 672 | GTTGAGCGCAGTAAGACAAC | mir-7-2 |
| 328764 | 673 | AGATGTTTCTGGCCTGCGAG | hypothetical miRNA-142 |
| 328765 | 674 | GACAAACTCAGCTATATTGT | mir-215 |
| 328766 | 675 | ACGGCTCTGTGGCACTCATA | mir-131-3 |
| 328767 | 676 | GCTTTCTTACTTTCCACAGC | mir-30c |
| 328768 | 677 | TACCTTTAGAATAGACAGCA | mir-101-1 |
| 328769 | 678 | AGGCTGGACAGCACACAACC | mir-26b |
| 328770 | 679 | AGCAGGAGCCTTATCTCTCC | hypothetical miRNA-156 |
| 328771 | 680 | ATGAGTGAGCAGTAGAATCA | mir-135-1 |
| 328772 | 681 | TGAGACTTTATTACTATCAC | mir-135-2 |
| 328773 | 682 | TACTTTACTCCAAGGTTTTA | mir-15a-2 |

TABLE 7-continued

Chimeric phosphorothioate oligomeric compounds having 2'-MOE wings and a deoxy gap targeting pri-miRNAs

| ISIS Number | SEQ ID NO | Sequence | pri-miRNA |
|---|---|---|---|
| 328774 | 683 | GCACCCGCCTCACACACGTG | mir-33b |
| 328775 | 684 | TTCCCGACCTGCCTTTACCT | hypothetical miRNA-166 |
| 328776 | 685 | TCCTGTAATTATAGGCTAGC | hypothetical miRNA-169 |
| 328777 | 686 | GGATCATATCAATAATACCA | hypothetical miRNA-172 |
| 328778 | 687 | TGCTGAGACACACAATATGT | hypothetical miRNA-176 |
| 328779 | 688 | TGTTTGTCTCCAAGAAACGT | hypothetical miRNA-177 |
| 328780 | 689 | TGTCATGGACAGGATGAATA | hypothetical miRNA-179 |
| 328781 | 690 | TCTATCATACTCAGAGTCGG | mir-148a |
| 328782 | 691 | TTGTGACAGGAAGCAAATCC | mir-23a |
| 328783 | 692 | CATCAGAGTCACCAACCCCA | hypothetical miRNA-185 |
| 328784 | 693 | CAAGAGATGTCTCGTTTTGC | hypothetical miRNA-186 |

Example 10

Chimeric Phosphorothioate Compounds Having 2'-MOE Wings and a Deoxy Gap Targeted to the Stem Loop of pri-miRNA Structures In accordance with the present invention, a fourth series of oligomeric compounds were designed to target the stem loop of different pri-miRNA structures. In some cases, these oligomeric compounds contain mismatches, and thus hybridize with partial complimentarity to the stemloop structure of the pri-miRNA targeted. The compounds are shown in Table 8. "Pri-miRNA" indicates the particular pri-miRNA that the oligomeric compound was designed to target. All compounds in Table 8 are chimeric oligonucleotides ("gapmers"), composed of a central "gap" region consisting of 2'-deoxynucleotides, which is flanked on both sides (5' and 3' directions) by "wings." The wings are composed of 2'-methoxyethoxy (2'-MOE) nucleotides. The internucleoside (backbone) linkages are phosphorothioate (P=S) throughout the oligonucleotide. All cytidine residues are 5-methylcytidines. The compounds can be analyzed for their effect on miRNA, pre-miRNA or pri-miRNA levels by quantitative real-time PCR as described, supra, or they can be used in other assays to investigate the role of miRNAs or downstream nucleic acid targets.

TABLE 8

Chimeric phosphorothioate compounds having 2'-MOE wings and a deoxy gap targeted to the stem loop of pri-miRNA structures

| Compound Number | SEQ ID NO. | Sequence | Pri-miRNA |
|---|---|---|---|
| RG1 | 694 | GTGGTAGAACAGCATGACGTC | mir-140 |
| RG2 | 695 | AGCTGTGAAGCCACGATGGGC | mir-30a |
| RG3 | 696 | AGATACAAAGATGGAAAAATC | mir-29b-1 |
| RG4 | 697 | CTTCCTTACTATTGCTCACAA | mir-34 |
| RG5 | 698 | TGTTTAATATATATTTCACTC | mir-16-3 |
| RG6 | 699 | TGTCAAGACATCGCGTTAACA | mir-203 |
| RG7 | 700 | TGTCGATTTAGTTATCCAACA | mir-7-1 |
| RG8 | 701 | GTGACTATACGGATACCACAC | mir-10b |
| RG9 | 702 | ACCTCTCCAAATGTAAAGA | mir-128a |
| RG10 | 703 | CAAAGCGGAAACCAATCACTG | mir-27b |
| RG11 | 704 | CTGCAGTACATGCACATATCA | mir-91 |
| RG12 | 705 | AACAATGACACCCTTGACCT | mir-132 |
| RG13 | 706 | TTTTAATCTTAAGTCACAAA | mir-23b |
| RG14 | 707 | ATCTCCACAGCGGGCAATGTC | let-7i |
| RG15 | 708 | TATGAAGACCAATACACTCCA | mir-131-2 |
| RG16 | 709 | GGGGCAACATCACTGCCC | let-7b |
| RG17 | 710 | CCATGTTAGCAGGTCCATATG | mir-1d |
| RG18 | 711 | GTTTGATAGTTTAGACACAAA | mir-122a |
| RG19 | 712 | TGGGTCAGGACTAAAGCTTC | mir-22 |
| RG20 | 713 | AATACCATACAGAAACACAGC | mir-92-1 |
| RG21 | 714 | TTCGTGATGATTGTCGTGCC | mir-142 |
| RG22 | 715 | ACTGCGAGACTGTTCACAGTT | mir-183 |
| RG23 | 716 | TACAGGTGAGCGGATGTTCTG | mir-214 |
| RG24 | 717 | TCTCAGCTCCCAACTGACCAG | mir-143 |
| RG25 | 718 | ACCGCAGATATTACAGCCACT | let-7a-3 |
| RG26 | 719 | CCTGATAGCCCTTCTTAAGGA | mir-181a |
| RG27 | 720 | CTTGATCCATATGCAACAAGG | mir-103-1 |
| RG28 | 721 | GCCATTGGGACCTCCACACC | mir-26a |
| RG29 | 722 | GCATGGGTACCACCCCATGC | mir-33a |
| RG30 | 723 | CGAGTTCAAAACTCAATCCCA | mir-196-2 |
| RG31 | 724 | CTTGAACTCCATGCCACAAGG | mir-107 |
| RG32 | 725 | GTAGATCTCAAAAAGCTAGC | mir-106 |
| RG33 | 726 | GAACAGGGTAAAATCACTAC | let-7f-1 |
| RG34 | 727 | AGACAAAAACAGACTCTGAA | mir-29c |
| RG35 | 728 | GCTAGTGACAGGTCCAGACAG | mir-130a |
| RG36 | 729 | TTTACTCATACCTCGCAACCA | mir-218-1 |

TABLE 8-continued

Chimeric phosphorothioate compounds having 2'-MOE wings and a deoxy gap targeted to the stem loop of pri-miRNA structures

| Compound Number | SEQ ID NO. | Sequence | Pri-miRNA |
|---|---|---|---|
| RG37 | 730 | TTAATTGTATGACATTAAATCA | mir-124a-2 |
| RG38 | 731 | TGCCATGAGATTCAACAGTCA | mir-21 |
| RG39 | 732 | GATAATATTTAGAATCTTAAC | mir-16-1 |
| RG40 | 733 | TAGTGTCTCATCGCAAACTTA | mir-144 |
| RG41 | 734 | CTGTTGCCTAACGAACACAGA | mir-221 |
| RG42 | 735 | TGCTGATTACGAAAGACAGGAT | mir-222 |
| RG43 | 736 | GCTTAGCTGTGTCTTACAGCT | mir-30d |

Example 11

Effects of Oligomeric Compounds Targeting miRNAs on Apoptosis in Caspase Assay

Programmed cell death or apoptosis involves the activation of proteases, a family of intracellular proteases, through a cascade which leads to the cleavage of a select set of proteins. The caspase family contains at least 14 caspases, with differing substrate preferences. The caspase activity assay uses a DEVD peptide to detect activated caspases in cell culture samples. The peptide is labeled with a fluorescent molecule, 7-amino-4-trifluoromethyl coumarin (AFC). Activated caspases cleave the DEVD peptide resulting in a fluorescence shift of the AFC. Increased fluorescence is indicative of increased caspase activity and consequently increased cell death. The chemotherapeutic drugs taxol, cisplatin, etoposide, gemcitabine, camptothecin, aphidicolin and 5-fluorouracil all have been shown to induce apoptosis in a caspase-dependent manner.

The effect of several oligomeric compounds of the present invention was examined in cells expressing miRNA targets. The cells expressing the targets used in these experiments were T47D, a breast carcinoma cell line. Other cell lines can also be employed in this assay and these include normal human mammary epithelial cells (HMECs) as well as two breast carcinoma cell lines, MCF7 and T47D. All of the cell lines were obtained from the American Type Culture Collection (Manassas, Va.). The latter two cell lines express similar genes but MCF7 cells express the tumor suppressor p53, while T47D cells are deficient in p53. MCF-7 cells are routinely cultured in DMEM low glucose (Gibco/Life Technologies, Gaithersburg, Md.) supplemented with 10% fetal calf serum (Gibco/Life Technologies, Gaithersburg, Md.). Cells were routinely passaged by trypsinization and dilution when they reached 90% confluence. T47D cells were cultured in Gibco DMEM High glucose media supplemented with 10% Fetal Bovine Serum (FBS).

Cells were plated at 10,000 cells per well for HMEC cells or 20,000 cells per well for MCF7 and T47D cells, and allowed to attach to wells overnight. Plates used were 96 well Costar plate 1603 (black sides, transparent bottom). DMEM high glucose medium, with and without phenol red, were obtained from Invitrogen (San Diego, Calif.). MEGM medium, with and without phenol red, were obtained from Biowhittaker (Walkersville, Md.). The caspase-3 activity assay kit was obtained from Calbiochem (Cat. #HTS02) (EMD Biosciences, San Diego, Calif.).

Before adding to cells, the oligomeric compound cocktail was mixed thoroughly and incubated for 0.5 hrs. The oligomeric compound or the LIPOFECTIN™-only vehicle control was added (generally from a 3 µM stock of oligonucleotide) to a final concentration of 200 nM with 6 µg/ml LIPOFECTIN™. The medium was removed from the plates and the plates were tapped on sterile gauze. Each well was washed in 150 µl of PBS (150 µL HBSS for HMEC cells). The wash buffer in each well was replaced with 100 µL of the oligomeric compound/OPTI-MEM™/LIPOFECTIN™ cocktail (this was T=0 for oligomeric compound treatment). The plates were incubated for 4 hours at 37° C., after which the medium was dumped and the plate was tapped on sterile gauze. 100 µl of full growth medium without phenol red was added to each well. After 48 hours, 50 µl of oncogene buffer (provided with Calbiochem kit) with 10 µM DTT was added to each well. 20 µl of oncogene substrate (DEVD-AFC) was added to each well. The plates were read at 400±25 nm excitation and 508±20 nm emission at t=0 and t=3 time points. The t=0×(0.8) time point was subtracted from the t=3 time point, and the data are shown as percent of LIPOFECTIN™-only (untreated control) treated cells.

Four experiments were performed and the results are shown in Tables 9-12. The concentration of oligomeric compound used was 200 nM. All compounds in Tables 9-12 are chimeric oligomeric compounds ("gapmers") 20 nucleotides in length, composed of a central "gap" region consisting of ten 2'-deoxynucleotides, which is flanked on both sides (5' and 3' directions) by five-nucleotide "wings." The wings are composed of 2'-methoxyethoxy (2'-MOE) nucleotides. The internucleoside (backbone) linkages are phosphorothioate (P═S) throughout the compound. All cytidine residues are 5-methylcytidines. As a control a 20-mer oligonucleotide random-mer, ISIS-29848 (NNNNNNNNNNNNNNNNNNNN; where N is A,T,C or G; herein incorporated as SEQ ID NO: 737) was used. In addition, two positive controls targeting expressed genes known to induce apoptosis when inhibited were included. These were ISIS-148715 (TTGTCCCAGTCCCAGGCCTC; herein incorporated as SEQ ID NO: 738) which targets human Jagged2 and ISIS-226844 (GCCCTCCATGCTGGCACAGG; herein incorporated as SEQ ID NO: 739) which targets human Notch1. Both positive controls have the same chemistry and gap structure as the compounds being tested. An increase in fluorescence indicates that the compound, by inhibiting its target, induces apoptosis as compared to untreated controls (UTC).

TABLE 9

Effects of oligomeric compounds targeting miRNAs on Apoptosis in Caspase Assay

| ISIS Number | SEQ ID NO. | Pri-miRNA | Fold Increase over UTC |
|---|---|---|---|
| UTC Untreated control | N/A | N/A | 1.0 |
| ISIS-29848 n-mer | 737 | N/A | 3.5 |
| ISIS-148715 Positive control | 738 | Jagged2 | 1.5 |
| ISIS-226844 Positive control | 739 | Notch1 | 3.6 |
| 328371 | 480 | mir-1d | 1.2 |
| 328400 | 509 | mir-196-2 | 1.3 |
| 328420 | 529 | mir-222 | 1.0 |

TABLE 9-continued

Effects of oligomeric compounds targeting miRNAs on Apoptosis in Caspase Assay

| ISIS Number | SEQ ID NO. | Pri-miRNA | Fold Increase over UTC |
|---|---|---|---|
| 328692 | 601 | mir-124a-1 | 1.2 |
| 328381 | 490 | mir-214 | 1.1 |
| 328691 | 600 | mir-145 | 0.9 |
| 328391 | 500 | hypothetical miRNA-044 | 0.8 |
| 328415 | 524 | mir-21 | 1.1 |
| 328433 | 542 | let-7d | 1.0 |
| 328643 | 552 | mir-204 | 0.9 |
| 328377 | 486 | hypothetical miRNA-030 | 0.7 |
| 328405 | 514 | let-7f-1 | 1.0 |
| 328372 | 481 | mir-122a | 1.0 |
| 328403 | 512 | mir-106 | 1.0 |
| 328424 | 533 | mir-19b-2 | 0.9 |
| 328648 | 557 | hypothetical miRNA-090 | 1.1 |
| 328397 | 506 | mir-103-1 | 1.2 |
| 328656 | 565 | hypothetical miRNA-099 | 1.1 |
| 328392 | 501 | hypothetical miRNA-044 | 1.0 |
| 328421 | 530 | mir-30d | 1.2 |
| 328417 | 526 | mir-16-1 | 1.0 |
| 328647 | 556 | mir-213 | 0.9 |
| 328378 | 487 | mir-142 | 1.0 |
| 328416 | 525 | mir-16-1 | 0.9 |

TABLE 10

Effects of oligomeric compounds targeting miRNAs on Apoptosis in Caspase Assay

| ISIS Number | SEQ ID NO. | Pri-miRNA | Fold Increase over UTC |
|---|---|---|---|
| UTC Untreated control | N/A | N/A | 0.9 |
| ISIS-29848 n-mer | 737 | N/A | 3.0 |
| ISIS-148715 Positive control | 738 | Jagged2 | 1.0 |
| ISIS-226844 Positive control | 739 | Notch1 | 3.1 |
| 328375 | 484 | mir-92-1 | 0.9 |
| 328382 | 491 | mir-143 | 0.9 |
| 328383 | 492 | mir-192-1 | 1.2 |
| 328385 | 494 | hypothetical miRNA-040 | 0.9 |
| 328395 | 504 | let-7a-1 | 1.0 |
| 328398 | 507 | mir-26a | 0.9 |
| 328399 | 508 | mir-33a | 1.0 |
| 328402 | 511 | mir-107 | 1.2 |
| 328408 | 517 | mir-29c | 0.9 |
| 328409 | 518 | mir-130a | 0.7 |
| 328422 | 531 | mir-30d | 1.0 |
| 328423 | 532 | mir-19b-2 | 0.6 |
| 328425 | 534 | mir-128b | 0.8 |
| 328431 | 540 | mir-133b | 0.9 |
| 328436 | 545 | mir-29a-1 | 0.9 |
| 328646 | 555 | hypothetical miRNA-088 | 1.1 |
| 328649 | 558 | mir-20 | 1.0 |
| 328651 | 560 | mir-138-2 | 0.9 |
| 328652 | 561 | mir-98 | 1.2 |
| 328657 | 566 | mir-181b | 0.8 |
| 328672 | 581 | mir-24-1 | 0.9 |
| 328694 | 603 | hypothetical miRNA-090 | 0.8 |
| 328696 | 605 | hypothetical miRNA-099 | 1.5 |
| 328700 | 609 | mir-24-1 | 0.8 |

TABLE 11

Effects of oligomeric compounds targeting miRNAs on Apoptosis in Caspase Assay

| ISIS Number | SEQ ID NO. | Pri-miRNA | Fold Increase over UTC |
|---|---|---|---|
| UTC Untreated control | N/A | N/A | 0.9 |
| ISIS-29848 n-mer | 737 | N/A | 3.2 |
| ISIS-148715 Positive control | 738 | Jagged2 | 1.1 |
| ISIS-226844 Positive control | 739 | Notch1 | 3.1 |
| 328374 | 483 | mir-22 | 1.1 |
| 328376 | 485 | mir-92-1 | 0.7 |
| 328384 | 493 | hypothetical miRNA-039 | 1.0 |
| 328386 | 495 | hypothetical miRNA-041 | 0.7 |
| 328390 | 499 | hypothetical miRNA-043 | 0.9 |
| 328393 | 502 | mir-181a | 1.5 |
| 328404 | 513 | mir-106 | 0.9 |
| 328406 | 515 | let-7f-1 | 1.0 |
| 328407 | 516 | hypothetical miRNA-055 | 1.2 |
| 328410 | 519 | hypothetical miRNA-058 | 1.5 |
| 328411 | 520 | hypothetical miRNA-058 | 0.8 |
| 328413 | 522 | mir-124a-2 | 0.8 |
| 328426 | 535 | hypothetical miRNA-069 | 1.3 |
| 328427 | 536 | hypothetical miRNA-070 | 0.8 |
| 328435 | 544 | mir-29a-1 | 1.3 |
| 328637 | 546 | hypothetical miRNA-079 | 1.0 |
| 328638 | 547 | mir-199b | 0.8 |
| 328639 | 548 | mir-129-1 | 0.8 |
| 328645 | 554 | mir-124a-1 | 2.2 |
| 328653 | 562 | mir-196-1 | 1.1 |
| 328654 | 563 | mir-125b-1 | 1.0 |
| 328655 | 564 | mir-199a-2 | 0.7 |
| 328689 | 598 | mir-199b | 0.8 |
| 328695 | 604 | mir-125b-1 | 0.8 |

TABLE 12

Effects of oligomeric compounds targeting miRNAs on Apoptosis in Caspase Assay

| ISIS Number | SEQ ID NO. | Pri-miRNA | Fold Increase over UTC |
|---|---|---|---|
| UTC Untreated control | N/A | N/A | 1.0 |
| ISIS-29848 n-mer | 737 | N/A | 3.5 |
| ISIS-148715 Positive control | 738 | Jagged2 | 1.3 |
| ISIS-226844 Positive control | 739 | Notch1 | 3.5 |
| 328373 | 482 | mir-122a | 0.9 |
| 328379 | 488 | mir-183 | 1.1 |
| 328387 | 496 | hypothetical miRNA-041 | 1.4 |
| 328388 | 497 | let-7a-3 | 0.9 |
| 328389 | 498 | hypothetical miRNA-043 | 1.1 |
| 328394 | 503 | mir-181a | 0.8 |
| 328396 | 505 | mir-205 | 0.8 |
| 328401 | 510 | mir-196-2 | 0.8 |
| 328412 | 521 | mir-218-1 | 1.2 |
| 328414 | 523 | mir-124a-2 | 0.9 |
| 328418 | 527 | mir-144 | 1.0 |
| 328419 | 528 | mir-221 | 0.7 |
| 328430 | 539 | mir-129-2 | 1.3 |
| 328432 | 541 | hypothetical miRNA-075 | 0.6 |
| 328434 | 543 | mir-15b | 0.8 |
| 328640 | 549 | let-7e | 0.9 |
| 328641 | 550 | hypothetical miRNA-083 | 1.1 |
| 328642 | 551 | let-7c | 1.0 |
| 328644 | 553 | mir-145 | 0.7 |
| 328650 | 559 | mir-133a-1 | 0.8 |
| 328658 | 567 | hypothetical miRNA-101 | 1.2 |

TABLE 12-continued

Effects of oligomeric compounds targeting miRNAs on Apoptosis in Caspase Assay

| ISIS Number | SEQ ID NO. | Pri-miRNA | Fold Increase over UTC |
|---|---|---|---|
| 328690 | 599 | mir-204 | 0.8 |
| 328693 | 602 | mir-213 | 1.0 |
| 328697 | 606 | mir-181b | 1.0 |

From these data, it is evident that SEQ ID NOs. 480, 509, 601, 490, 524, 557, 506, 565, 530, 605, 492, 561, 511, 555, 483, 502, 535, 562, 544, 519, 516, 554, 496, 567, 521, 539, 488, 498, and 550 induce apoptosis in T47D cells, while SEQ ID NOs. 500, 486, 518, 532, 534, 566, 603, 609, 485, 495, 520, 522, 536, 547, 548, 564, 598, 604, 503, 505, 510, 528, 541, 543, 553, 559, and 599 prevent or have a protective effect from apoptosis in the same system.

Example 12

Oligomeric Compounds Targeting the mir-30a pri-miRNA Structure

In one embodiment of the invention, oligomeric compounds targeting the hairpin structure of mir-30a pri-miRNA were designed and tested for their effects on miRNA signaling in 293T cells (American Type Culture Collection (Manassas, Va.)).

A synthetic DNA fragment comprised of four tandem repeats of the target site for mir-30a was cloned into the vector pGL3-C (purchased from Promega Corp., Madison Wis.) at the unique XbaI site (pGL3C-M30-4X). This places the target site in the 3'UTR of the luciferase reporter vector. An oligomeric compound mimicking the mir-30a pri-miRNA (AATT-TAATACGACTCACTATAGGGCGACTG-TAAACATCCTCGACTGGAAGCTG TGAAGCCACAGATGGGCTTTCAGTCG-GATGTTTGCAGCTGC, herein incorporated as SEQ ID NO: 1749) was in vitro transcribed using T7 RNA polymerase and a DNA template produced by PCR (the T7 promoter is shown in bold).

On the day prior to the experiment 24-well plates were seeded with 293T cells at 50% confluency. The following morning cells were treated with oligomeric compounds targeted to the mir-30a pri-miRNA mimic. The oligomeric compounds used in this study are shown in Table 13. All of the compounds are 20 nucleobases in length having either a phosphorothioate backbone throughout (PS) or a phosphodiester backbone throughout (PO). As designated in the table, ISIS 328076, 328078, 328081, 328084, 328086, 328088 are chimeric oligomeric compounds ("gapmers") 20 nucleotides in length, composed of a central "gap" region consisting of ten 2'-deoxynucleotides, which is flanked on both sides (5' and 3' directions) by five-nucleotide "wings." The wings are composed of 2'-methoxyethoxy (2'-MOE) nucleotides. All cytidine residues are 5-methylcytidines. The remaining compounds in the table have 2'-methoxyethoxy (MOE) nucleotides throughout with either a phosphorothioate (PS) or phosphodiester (PO) internucleoside linkages.

If the compound targeted the pre-loop of the mir-30a pri-miRNA structure, that designation is also noted in the table.

TABLE 13

Oligomeric compounds targeting the mir-30a pri-miRNA

| Isis Number | Sequence | Chemistry | SEQ ID NO |
|---|---|---|---|
| 328075 | GCTTCACAGCTTCCAGTCGA | (PS/MOE) | 740 |
| 328076 | GCTTCACAGCTTCCAGTCGA | (PS/MOE 5-10-5 gapmer) | 740 |
| 328077 | CCCATCTGTGGCTTCACAGC | (PS/MOE); pre-loop | 741 |
| 328078 | CCCATCTGTGGCTTCACAGC | (PS/MOE 5-10-5 gapmer); pre-loop | 741 |
| 328079 | CCCATCTGTGGCTTCACAGC | (PO/MOE); pre-loop | 741 |
| 328080 | TGAAAGCCCATCTGTGGCTT | (PS/MOE); pre-loop | 742 |
| 328081 | TGAAAGCCCATCTGTGGCTT | (PS/MOE 5-10-5 gapmer); pre-loop | 742 |
| 328082 | TGAAAGGCCATCTGTGGCTT | (PO/MOE); pre-loop | 742 |
| 328083 | GCAGCTGCAAACATCCGACT | (PS/MOE) | 743 |
| 328084 | GCAGCTGCAAACATCCGACT | (PS/MOE 5-10-5 gapmer) | 743 |
| 328085 | CATCTGTGGGTTCACAGCTT | (PS/MOE) | 744 |
| 328086 | CATCTGTGGCTTCACAGCTT | (PS/MOE 5-10-5 gapmer) | 744 |
| 328087 | AAGCCCATCTGTGGCTTCAC | (PS/MOE) | 745 |
| 328088 | AAGCCCATCTGTGGCTTCAC | (PS/MOE 5-10-5 gapmer) | 745 |

Cells were washed once with PBS then oligomeric compounds were added to triplicate wells at 150 nM in OPTI-MEM™ media and 4.5 μl/ml LIPOFECTIN™ reagent (Invitrogen Corporation, Carlsbad, Calif.). After 3 hours, the media was removed, and the cells were treated with the mir-30a pri-miRNA mimic at 200 nM in OPTI-MEM™ with 6 μl/ml LIPOFECTIN™ reagent. After 3 hours the media was removed from the cells. The reporter plasmid, pGL3C-M30-4X, was then transfected using SuperFect reagent. 20 μg of pGL3C-M30-4X and 2 μg of pRL-CMV, a plasmid expressing Renilla luciferase, were suspended in 600 μl of serum-free DMEM to which 120 μl of Superfect was added. After a 5 minute incubation, 6 mls of DMEM+10% FCS was added. 125 μl of the plasmid/SuperFect suspension was added to each well. After a 2 hour incubation cells were washed and fresh growth media added. Cells were incubated overnight.

The following morning the media was removed and the cells were lysed in 120 μl passive lysis buffer (PLB; Promega). 40 μl of the lysate was then assayed for Photinus (PL) and Renilla (RL) luciferases using a Dual Luciferase Assay kit (Promega) according to the manufacturer's protocol. The results below are given as percent pGL3C-M30-4X expression (PL) normalized to pRL-CMV expression (RL). The 20-nucleobase oligonucleotide random-mer ISIS Number 29848 was used as a negative control. The data are shown in Table 14.

TABLE 14

Effects of oligomeric compounds targeting the mir-30a pri-miRNA on reporter gene expression

| SEQ ID NO | ISIS Number | percent control luciferase expression |
|---|---|---|
| N/A | Untreated control | 100 |
| N/A | Mir-30a pri-miRNA only | 62 |
| 737 | 29848 control added after mir-30a pri-miRNA | 63 |
| 292 | 327874 | 66 |
| 740 | 328075 | 55 |
| 740 | 328076 | 57 |
| 741 | 328077 | 70 |
| 741 | 328078 | 63 |
| 742 | 328080 | 72 |
| 742 | 328081 | 80 |
| 743 | 328084 | 75 |
| 744 | 328085 | 72 |
| 744 | 328086 | 95 |
| 745 | 328087 | 83 |
| 745 | 328088 | 107 |

Upon adminstration of the mir-30a pri-miRNA mimic, the pri-miRNA is believed to be processed in the cell by the endogenous Drosha RNase III enzyme into a pre-miRNA, which is then processed by human Dicer into a mature miRNA, which is then able to hybridize to the target site, thus effectively reducing luciferase reporter expression.

Upon treatment of the system with the oligomeric compounds targeting the mir-30a pri-miRNA, the processing and/or production of the mir-30a mature miRNA is inhibited, and the mir-30a miRNA is no longer able to bind its target site, thus allowing luciferase reporter expression to increase.

Cells treated with mir-30a pri-miRNA mimic show an approximately 38% reduction in luciferase expression compared to the untreated controls. Treatment with ISIS 328086, 328087 and 328088 had the most dramatic effect in reversing the mir-30a miRNA-mediated silencing, restoring luciferase reporter expression to near control levels. Thus, it was demonstrated that the oligomeric compound mimicking the mir-30a pri-miRNA silences luciferase activity from the reporter vector, and that oligomeric compounds targeting the mir-30a pri-miRNA can inhibit its silencing activity, possibly by interfering with its processing into the pre-miRNA or mature miRNA molecules.

ISIS 328085 to ISIS 328088 were designed to target the mir-30a pri-miRNA as pseudo half-knot compounds. Methods for the preparation of pseudo half-knot compounds are disclosed in U.S. Pat. No. 5,512,438 which is incorporated herein by reference. This motif has been used to disrupt the structure of regulatory RNA stem loops in larger viral genomic structures. (Ecker et al, *Science.* 1992; 257:958-61). However, this is the first example of the pseudo half-knot motif being used to regulate a small non-coding RNA, more specifically a miRNA such as those disclosed herein. It is also the first demonstration of apoptotic modulation in a cell by pseudo half-knot structured oligomeric compounds.

Example 13

Effects of Oligomeric Compounds Targeting miRNAs on Expression of Adipocyte Differentiation Markers The effect of several oligomeric compounds of the present invention targeting miRNAs on the expression of markers of cellular differentiation was examined in preadipocytes.

One of the hallmarks of cellular differentiation is the upregulation of gene expression. During adipocyte differentiation, the gene expression patterns in adipocytes change considerably. An excessive recruitment and differentiation of preadipocytes into mature adipocytes is a characteristic of human obesity, which is a strong risk factor for type 2 diabetes, hypertension, atherosclerosis, cardiovascular disease, and certain cancers. Some genes known to be upregulated during adipocyte differentiation include hormone-sensitive lipase (HSL), adipocyte lipid binding protein (aP2), glucose transporter 4 (Glut4), and PPARγ (Peroxisome proliferator-activated receptor gamma). These genes play important roles in the uptake of glucose and the metabolism and utilization of fats. For example, HSL is involved in the mobilization of fatty acids from adipose tissue into the bloodstream; studies suggest that increased free fatty acid levels are one of the causative factors in type 2 diabetes. aP2 is believed to play a role in athersclerosis. Glut4 is important in insulin signaling. PPARγ is believed to be involved in adipocyte differentiation, insulin sensitivity, and colonic tumor development.

Leptin is also a marker for differentiated adipocytes. In the adipocyte assay, leptin secretion into the media above the differentiated adipocytes was measured by protein ELISA. Cell growth, transfection and differentiation procedures were carried out as described for the Triglyceride accumulation assay (see below). On day nine post-transfection, 96-well plates were coated with a monoclonal antibody to human leptin (R&D Systems, Minneapolis, Minn.) and left at 4° C. overnight. The plates were blocked with bovine serum albumin (BSA), and a dilution of the media was incubated in the plate at RT for 2 hours. After washing to remove unbound components, a second monoclonal antibody to human leptin (conjugated with biotin) was added. The plate was then incubated with strepavidin-conjugated horseradish peroxidase (HRP) and enzyme levels are determined by incubation with 3, 3', 5, 5'-Tetramethlybenzidine, which turns blue when cleaved by HRP. The $OD_{450}$ was read for each well, where the dye absorbance is proportional to the leptin concentration in the cell lysate. Results are expressed as a percent±standard deviation relative to transfectant-only controls.

An increase in triglyceride content is another well-established marker for adipocyte differentiation. The triglyceride accumulation assay measures the synthesis of triglyceride by adipocytes. Triglyceride accumulation was measured using the Infinity™ Triglyceride reagent kit (Sigma-Aldrich, St. Louis, Mo.). Human white preadipocytes (Zen-Bio Inc., Research Triangle Park, N.C.) were grown in preadipocyte media (ZenBio Inc.). One day before transfection, 96-well plates were seeded with 3000 cells/well. Cells were transfected according to standard published procedures with 250 nM oligomeric compound in LIPOFECTIN™ (Invitrogen Corporation, Carlsbad, Calif.) (Monia et al., J. Biol. Chem. 1993 268(19):14514-22). Oligomeric compounds were tested in triplicate on each 96-well plate, and the effects of TNF-α, a positive drug control that inhibits adipocyte differentiation, were also measured in triplicate. Negative and transfectant-only controls may be measured up to six times per plate. After the cells have reached confluence (approximately three days), they were exposed to differentiation media (Zen-Bio, Inc.) containing a PPAR-γ agonist, IBMX, dexamethasone, and insulin for three days. Cells were then fed adipocyte media (Zen-Bio, Inc.), which was replaced at 2 to 3 day intervals. On day nine post-transfection, cells were washed and lysed at room temperature, and the triglyceride assay reagent was added. Triglyceride accumulation was measured based on the amount of glycerol liberated from triglycerides by the enzyme lipoprotein lipase. Liberated glycerol is phosphorylated by glycerol kinase, and hydrogen peroxide is generated during the oxidation of glycerol-1-phosphate to dihydroxyacetone phosphate by glycerol phosphate oxidase. Horseradish peroxidase (HRP) uses $H_2O_2$ to oxidize 4-aminoantipyrine and 3,5 dichloro-2-hydroxybenzene sulfonate to produce a red-colored dye. Dye absorbance, which is proportional to the concentration of glycerol, was measured at 515 nm using an UV spectrophotometer. Glycerol concentration was calculated from a standard curve for each assay, and data were normalized to total cellular protein as determined by a Bradford assay (Bio-Rad Laboratories, Hercules, Calif.). Results are expressed as a percent±standard deviation relative to transfectant-only control.

For assaying adipocyte differentiation, expression of the four hallmark genes, HSL, aP2, Glut4, and PPARγ, as well as triglyceride (TG) accumulation and leptin secretion were measured in adipocytes transfected with the uniform 2'-MOE phosphorothioate (PS) oligomeric compounds previously described. Cells are lysed on day nine post-transfection, in a guanadinium-containing buffer and total RNA is harvested. Real-time PCR is performed (Applied Biosystems, Prism 7700) on the total RNA using the following primer/probe sets for the adipocyte differentiation hallmark genes: (aP2): forward 5'-GGTGGTGGAATGCGTCATG-3' (SEQ ID NO: 746), reverse 5'-CAACGTCCCTTGGCTTATGC-3' (SEQ ID NO: 747), probe 5'-FAM-AAGGCGTCACTTCCAC-GAGAGTTTATGAGA-TAMRA-3' (SEQ ID NO: 748); (Glut4): forward 5'-GGCCTCCGCAGGTTCTG-3' (SEQ ID NO: 749), reverse 5'-TTCGGAGCCTATCTGTTGGAA-3' (SEQ ID NO: 750), probe 5'-FAM-TCCAGGCCGGAGT-CAGAGACTCCA-TAMRA-3' (SEQ ID NO: 751); (HSL): forward 5'-ACCTGCGCACAATGACACA-3' (SEQ ID NO: 752), reverse 5'-TCGCTCGAGAAGAAGGCTATG-3' (SEQ ID NO: 753), probe 5'-FAM-CCTCCGCCAGAGTCAC-CAGCG-TAMRA-3' (SEQ ID NO: 754); (PPAR-y): forward 5'-AAATATCAGTGTGAATTACAGCAAACC-3' (SEQ ID NO: 755), reverse 5'-GCAATCGCTTTCTGGGTCAA-3' (SEQ ID NO: 756), probe 5'-FAM-TGCTGTTATGGGT-GAAACTCTGGGAGATTCT-TAMRA-3' (SEQ ID NO: 757). The amount of total RNA in each sample is determined using a Ribogreen Assay (Molecular Probes, Eugene, Oreg.), and expression levels of the adipocyte differentiation hallmark genes were normalized to total RNA. Leptin protein and triglyceride levels as well as mRNA levels for each of the four adipocyte differentiation hallmark genes are expressed relative to control levels (control=treatment with ISIS-29848 (SEQ ID NO: 737)). Results of two experiments are shown in Tables 15 and 16.

TABLE 15

Effects of oligomeric compounds targeting miRNAs on expression of adipocyte differentiation markers

| ISIS Number | SEQ ID NO | TG | AP2 | HSL | Glut4 | PPAR gamma |
|---|---|---|---|---|---|---|
| 327876 | 294 | 0.47 | 0.75 | 0.47 | 0.36 | 0.57 |
| 327878 | 296 | 0.65 | 0.85 | 0.93 | 0.69 | 0.97 |
| 327880 | 298 | 0.52 | 0.97 | 0.80 | 1.11 | 0.53 |
| 327888 | 306 | 0.98 | 1.18 | 1.38 | 1.37 | 1.36 |
| 327889 | 307 | 0.47 | 0.69 | 0.59 | 0.55 | 0.71 |
| 327890 | 308 | 0.92 | 0.91 | 0.86 | 1.10 | 1.18 |
| 327892 | 310 | 0.42 | 0.31 | 0.25 | 0.07 | 0.32 |
| 327901 | 319 | 0.54 | 0.42 | 0.33 | 0.19 | 0.30 |
| 327903 | 321 | 1.20 | 1.15 | 1.23 | 1.72 | 1.19 |
| 327905 | 323 | 0.69 | 1.14 | 1.11 | 0.84 | 0.54 |
| 327913 | 331 | 0.59 | 0.99 | 0.92 | 0.84 | 0.72 |
| 327919 | 337 | 0.58 | 0.79 | 0.57 | 0.32 | 0.52 |
| 327922 | 340 | 1.09 | 0.99 | 0.95 | 1.75 | 1.37 |
| 327925 | 343 | 0.72 | 0.77 | 0.78 | 1.99 | 0.60 |
| 327933 | 351 | 1.48 | 1.46 | 1.35 | 2.52 | 1.52 |
| 327934 | 352 | 0.99 | 1.20 | 1.02 | 1.22 | 0.97 |
| 327939 | 357 | 0.92 | 1.08 | 1.21 | 0.87 | 0.83 |
| 327941 | 359 | 1.31 | 1.78 | 1.73 | 2.07 | 0.80 |
| 327954 | 372 | 0.58 | 0.95 | 1.03 | 0.92 | 0.73 |

TABLE 16

Effects of oligomeric compounds targeting miRNAs on expression of adipocyte differentiation markers

| ISIS Number | SEQ ID NO | TG | Leptin | AP2 | HSL | Glut4 | PPAR gamma |
|---|---|---|---|---|---|---|---|
| 327888 | 306 | 0.44 | 1.38 | 0.47 | 0.50 | 0.17 | 0.66 |
| 327889 | 307 | 0.46 | 1.05 | 0.57 | 0.54 | 0.46 | 0.82 |
| 327890 | 308 | 0.61 | 1.36 | 0.69 | 0.67 | 0.67 | 0.94 |
| 327893 | 311 | 0.95 | 1.14 | 0.97 | 0.85 | 1.47 | 1.03 |
| 327901 | 319 | 0.53 | 1.02 | 0.47 | 0.47 | 0.29 | 0.72 |
| 327903 | 321 | 0.58 | 1.61 | 0.92 | 0.80 | 1.12 | 0.98 |
| 327905 | 323 | 0.58 | 1.62 | 0.68 | 0.69 | 0.40 | 0.83 |
| 327919 | 337 | 0.40 | 1.44 | 0.48 | 0.37 | 0.18 | 0.57 |
| 327922 | 340 | 0.43 | 1.25 | 0.75 | 0.72 | 0.43 | 0.80 |
| 327925 | 343 | 0.63 | 1.40 | 0.77 | 0.75 | 0.61 | 0.83 |
| 327926 | 344 | 1.06 | 1.47 | 0.85 | 0.82 | 1.10 | 0.93 |
| 327930 | 348 | 0.97 | 0.95 | 0.86 | 0.89 | 1.01 | 0.98 |
| 327931 | 349 | 1.11 | 1.12 | 1.00 | 0.99 | 1.37 | 1.56 |
| 327934 | 352 | 0.62 | 1.25 | 0.66 | 0.64 | 0.44 | 0.72 |
| 327938 | 356 | 1.05 | 1.35 | 0.86 | 0.85 | 0.80 | 0.90 |
| 327939 | 357 | 0.59 | 2.67 | 0.69 | 0.63 | 0.30 | 0.70 |
| 327941 | 359 | 0.42 | 0.54 | 0.88 | 0.81 | 0.44 | 0.86 |
| 327942 | 360 | 0.85 | 2.03 | 0.82 | 0.79 | 0.66 | 0.87 |
| 327955 | 373 | 0.81 | 1.22 | 0.74 | 0.82 | 0.45 | 0.92 |
| 327967 | 385 | 0.90 | 1.22 | 0.86 | 0.97 | 0.56 | 0.89 |

From these data, values above 1.0 for triglyceride accumulation (column "TG" in the tables) indicate that the compound has the ability to stimulate triglyceride accumulation, whereas values at or below 1.0 indicate that the compound inhibits triglyceride accumulation. With respect to leptin secretion (column "Leptin" in the tables), values above 1.0 indicate that the compound has the ability to stimulate secretion of the leptin hormone, and values at or below 1.0 indicate that the compound has the ability to inhibit secretion of leptin.

With respect to the four adipocyte differentiation hallmark genes (columns "AP2," "HSL," "Glu4," and "PPAR gamma" in the tables), values above 1.0 indicate induction of cell differentiation, whereas values at or below 1.0 indicate that the compound inhibits differentiation.

Several compounds were found to have remarkable effects. For example, the oligomeric compounds ISIS Number 327889 (SEQ ID NO: 307), targeted to mir-23b; ISIS Number 327892 (SEQ ID NO: 310), targeted to mir-131-1, mir-131-2 and mir-131-3 (also known as mir-9); ISIS Number 327942 (SEQ ID NO: 360) targeted to mir-141 and ISIS Number 327901 (SEQ ID NO: 319), targeted to mir-143 were shown to significantly reduce the expression levels of 5 of 6 markers of adipocyte differentiation (excepting leptin levels), indicating that these oligomeric compounds have the ability to block adipocyte differentiation. Therefore, these oligomeric compounds may be useful as pharmaceutical agents with applications in the treatment, attenuation or prevention of obesity, hyperlipidemia, atherosclerosis, atherogenesis, diabetes, hypertension, or other metabolic diseases as well as having potential applications in the maintenance of the pluripotent phenotype of stem or precursor cells.

The compound ISIS Number 327939 (SEQ ID) NO: 357), targeted to mir-125b-1, for example, produced surprising results in that it demonstrates a significant increase in leptin secretion but a concomitant decrease in triglyeride accumulation and a decrease in the expression of all four adipocyte differentiation hallmark genes, indicating that this oligomeric compound may be useful as a pharmaceutic agent in the treatment of obesity, as well as having applications in other metabolic diseases.

The oligomeric compound ISIS Number 327931 (SEQ ID NO: 349), targeted to let-7c is an example of a compound which demonstrates an increase in four out of six markers of adipocyte differentiation, including a significant increase in the expression of PPAR-γ. This oligomeric compound may be useful as a pharmaceutical agent in the treatment of diseases in which the induction of cell differentiation is desirable.

The oligomeric compound ISIS Number 327933 (SEQ ID NO: 351), targeted to mir-145 is an example of a compound which demonstrates an increase in all six markers of adipocyte differentiation. This oligomeric compound may be useful as a pharmaceutical agent in the treatment of diseases in which the induction of adipocyte differentiation is desirable, such as anorexia, or for conditions or injuries in which the induction of cellular differentiation is desireable, such as Alzheimers disease or central nervous system injury, in which regeneration of neural tissue (such as from pluripotent stem cells) would be beneficial. Furthermore, this oligomeric compound may be useful in the treatment, attenuation or prevention of diseases in which it is desireable to induce cellular differentiation and/or quiescence, for example in the treatment of hyperproliferative disorders such as cancer.

In some embodiments, differentiating adipocytes were treated with uniform 2'-MOE phosphorothioate oligomeric compounds according to the methods described above, and the expression of the four hallmark genes, HSL, aP2, Glut4, and PPARγ, as well as triglyceride (TG) accumulation were measured. TG levels as well as mRNA levels for each of the four adipocyte differentiation hallmark genes are expressed as a percentage of control levels (control=treatment with ISIS 342673; AGACTAGCGGTATCTTTATCCC; herein incorporated as SEQ ID NO: 758), a uniform 2'-MOE phosphorothioate oligomeric compound containing 15 mismatches with respect to the mature mir-143 miRNA). Undifferentiated adipocytes were also compared as a negative control. As a positive control, differentiating adipocytes were treated with ISIS 105990 (AGCAAAAGATCAATCCGTTA; herein incorporated as SEQ ID NO: 759), a 5-10-5 gapmer oligomeric compound targeting the PPAR-gamma mRNA, previously demonstrated to inhibit adipocyte differentiation. The effects of TNF-α, also known to inhibit adipocyte differentiation, were also measured. Results of these experiments are shown in Tables 17 and 18.

TABLE 17

Effects of oligomeric compounds targeting miRNAs on expression of adipocyte differentiation markers

| ISIS Number | SEQ ID NO | TG | AP2 | HSL | Glut4 | PPAR gamma |
|---|---|---|---|---|---|---|
| Untreated control | N/A | 88.5 | 87.8 | 88.6 | 102.7 | 94.9 |
| 105990 | 759 | 28.2 | 51.6 | 49.2 | 59.5 | 51.8 |
| 342673 | 758 | 100.0 | 100.0 | 100.0 | 100.0 | 100.0 |
| TNF-alpha | N/A | 10.0 | 5.5 | 0.7 | 0.5 | 18.8 |
| Undiff. adipocytes | N/A | 2.7 | 0.0 | 0.3 | 0.1 | 9.2 |
| 328116 | 418 | 82.1 | 87.7 | 75.8 | 75.2 | 78.4 |
| 328117 | 419 | 55.0 | 65.4 | 61.7 | 68.1 | 64.1 |
| 328118 | 420 | 69.3 | 92.7 | 85.3 | 76.6 | 80.2 |
| 328119 | 421 | 90.2 | 99.9 | 98.5 | 95.2 | 82.7 |
| 328120 | 422 | 82.7 | 81.0 | 77.7 | 94.8 | 70.5 |
| 328121 | 423 | 134.8 | 127.0 | 126.0 | 140.8 | 103.6 |
| 328122 | 424 | 78.9 | 79.3 | 72.7 | 85.9 | 77.8 |
| 328123 | 425 | 120.8 | 106.7 | 85.4 | 162.4 | 74.7 |
| 328124 | 426 | 99.1 | 101.8 | 103.6 | 122.7 | 90.4 |
| 328125 | 427 | 81.7 | 86.9 | 75.8 | 99.5 | 76.1 |
| 328126 | 428 | 98.9 | 90.9 | 83.2 | 100.7 | 75.0 |
| 328127 | 429 | 74.5 | 86.9 | 89.7 | 80.8 | 77.6 |
| 328128 | 430 | 98.7 | 100.7 | 94.1 | 101.9 | 84.0 |
| 328129 | 431 | 53.8 | 67.6 | 56.5 | 60.0 | 71.8 |
| 328130 | 432 | 122.4 | 86.6 | 76.5 | 83.8 | 99.4 |
| 328131 | 433 | 89.1 | 95.4 | 81.8 | 103.6 | 88.2 |
| 328132 | 434 | 114.1 | 90.2 | 73.7 | 72.1 | 90.0 |
| 328133 | 435 | 61.2 | 69.5 | 63.0 | 91.9 | 63.8 |
| 328134 | 436 | 85.7 | 80.1 | 74.7 | 88.3 | 78.4 |
| 328135 | 437 | 63.6 | 80.6 | 76.7 | 90.3 | 70.0 |
| 328136 | 438 | 47.0 | 73.0 | 65.0 | 66.7 | 72.7 |
| 328137 | 439 | 83.2 | 99.6 | 86.3 | 88.5 | 85.7 |
| 328138 | 440 | 100.6 | 85.3 | 89.8 | 86.8 | 83.8 |
| 328139 | 441 | 89.1 | 98.3 | 92.6 | 106.3 | 115.0 |

TABLE 18

Effects of oligomeric compounds targeting miRNAs on expression of adipocyte differentiation markers

| ISIS # | SEQ ID NO | TG | AP2 | HSL | Glut4 | PPAR gamma |
|---|---|---|---|---|---|---|
| Untreated control | N/A | 102.2 | 90.8 | 94.9 | 117.8 | 103.3 |
| 105990 | 759 | 32.8 | 49.8 | 52.0 | 68.1 | 60.1 |
| 342673 | 758 | 100 | 100 | 100 | 100 | 100 |
| TNF-alpha | N/A | 14.5 | 9.6 | 3.1 | 1.9 | 27.9 |
| Undiff. adipocytes | N/A | 2.8 | 0.0 | 1.4 | 0.3 | 10.7 |
| 327912 | 330 | 107.4 | 90.1 | 90.6 | 89.0 | 76.9 |
| 327969 | 387 | 46.0 | 59.8 | 66.4 | 60.6 | 69.2 |
| 328099 | 401 | 93.9 | 85.9 | 88.4 | 86.8 | 81.9 |
| 328100 | 402 | 71.5 | 61.9 | 72.0 | 74.2 | 66.7 |
| 328101 | 403 | 108.6 | 83.2 | 91.8 | 84.7 | 79.3 |
| 328102 | 404 | 95.9 | 87.9 | 97.0 | 79.2 | 93.7 |
| 328103 | 405 | 110.2 | 83.2 | 82.5 | 94.3 | 74.3 |
| 328104 | 406 | 122.6 | 102.2 | 98.2 | 119.1 | 90.4 |
| 328105 | 407 | 93.1 | 88.2 | 94.2 | 94.2 | 93.3 |
| 328106 | 408 | 90.5 | 88.8 | 94.9 | 105.7 | 90.7 |
| 328107 | 409 | 66.7 | 67.5 | 61.0 | 72.5 | 79.3 |
| 328108 | 410 | 89.6 | 83.7 | 90.1 | 94.9 | 84.0 |
| 328109 | 411 | 84.9 | 84.9 | 86.9 | 106.6 | 96.1 |
| 328110 | 412 | 97.7 | 93.3 | 91.0 | 104.7 | 91.2 |
| 328111 | 413 | 101.9 | 71.5 | 69.5 | 59.6 | 74.9 |

TABLE 18-continued

Effects of oligomeric compounds targeting miRNAs on expression of adipocyte differentiation markers

| ISIS # | SEQ ID NO | TG | AP2 | HSL | Glut4 | PPAR gamma |
|---|---|---|---|---|---|---|
| 328112 | 414 | 98.1 | 99.1 | 101.2 | 122.5 | 102.4 |
| 328113 | 415 | 80.8 | 84.5 | 90.6 | 99.9 | 93.8 |
| 328114 | 416 | 117.3 | 94.4 | 93.3 | 114.9 | 89.3 |
| 328115 | 417 | 108.7 | 80.0 | 89.0 | 132.0 | 95.8 |
| 341803 | 760 | 85.9 | 77.3 | 75.5 | 86.8 | 71.2 |
| 341804 | 761 | 60.9 | 70.8 | 71.6 | 73.6 | 74.1 |
| 341805 | 762 | 78.1 | 81.9 | 81.8 | 88.2 | 80.4 |
| 341806 | 763 | 83.2 | 75.8 | 73.4 | 69.4 | 72.6 |
| 341807 | 764 | 114.1 | 74.8 | 96.8 | 119.5 | 86.2 |

Several compounds were found to have remarkable effects. For example, the oligomeric compounds ISIS Number 328117 (SEQ ID NO: 419), targeted to hypothetical miRNA-144, ISIS Number 328129 (SEQ ID NO: 431), targeted to hypothetical miRNA-173, ISIS Number 328136 (SEQ ID NO: 438), targeted to hypothetical miRNA-181, and ISIS Number 327969 (SEQ ID NO: 387), targeted to mir-182, were each shown to reduce the expression levels of triglycerides by at least 50%, and treatment with ISIS 328117, 328129, or 328136 also each resulted in a reduction of expression of the other four hallmark genes, indicating that these oligomeric compounds targeted to hypothetical miRNA-144, hypothetical miRNA-173, hypothetical miRNA-181, and mir-182, may be useful as therapeutic agents with applications in the treatment, attenuation or prevention of obesity, hyperlipidemia, atherosclerosis, atherogenesis, diabetes, hypertension, or other metabolic diseases.

The oligomeric compound ISIS Number 328121 (SEQ ID NO: 423), targeted to hypothetical miRNA-161 is an example of a compound which stimulates an increase in all five markers of adipocyte differentiation. This oligomeric compound may be useful as a pharmaceutical agent in the treatment of diseases in which the induction of adipocyte differentiation is desirable, such as anorexia, or for conditions or injuries in which the induction of cellular differentiation is desireable, such as Alzheimers disease or central nervous system injury, in which regeneration of neural tissue would be beneficial. Furthermore, this oligomeric compound may be useful in the treatment, attenuation or prevention of diseases in which it is desireable to induce cellular differentiation and/or quiescence, for example in the treatment of hyperproliferative disorders such as cancer.

Example 14

Expression of mir-143 in Human Tissues and Cell Lines

Total RNA from spleen, kidney, testicle, heart and liver tissues as well as total RNA from human promyelocytic leukemia HL-60 cells, human embryonic kidney 293 (HEK293) cells, and T47D human breast carcinoma cells was purchased from Ambion, Inc. (Austin, Tex.). RNA from preadipocytes and differentiated adipocytes was purchased from Zen-Bio, Inc. (Research Triangle Park, N.C.). RNA was prepared from the HeLa, NT2, T-24, and A549 cell lines cultured as described above, using the following protocol: cell monolayers were washed twice with cold PBS, and cells were lysed in 1 mL TRIZOL™ (Invitrogen) and total RNA prepared using the manufacturer's recommended protocols.

Fifteen to twenty micrograms of total RNA was fractionated by electrophoresis through 10% acrylamide urea gels using a TBE buffer system (Invitrogen). RNA was transferred from the gel to HYBOND™-N+ nylon membranes (Amersham Pharmacia Biotech, Piscataway, N.J.) by electroblotting in an Xcell SureLock™ Minicell (Invitrogen). Membranes were fixed by UV cross-linking using a STRATALINKER™ UV Crosslinker 2400 (Stratagene, Inc, La Jolla, Calif.) and then probed using Rapid Hyb buffer solution (Amersham) using manufacturer's recommendations for oligonucleotide probes.

To detect mir-143, a target specific DNA oligonucleotide probe with the sequence TGAGCTACAGTGCTTCATCTCA (SEQ ID NO: 319) was synthesized by IDT (Coralville, Iowa). The oligo probe was 5' end-labeled with T4 polynucleotide kinase with ($\gamma$-$^{32}$P) ATP (Promega). To normalize for variations in loading and transfer efficiency membranes can be stripped and probed for U6 RNA. Hybridized membranes were visualized and quantitated using a Storm 860 PHOSPHORIMAGER™ and IMAGEQUANT™ Software V3.3 (Molecular Dynamics, Sunnyvale, Calif.).

Using this probe, the mir-143 miRNA was found to be most highly expressed in human heart, thymus and kidney, and was also expressed to a lesser extent in lung, spleen, liver, and brain tissues. For example, as compared to expression levels in liver, mir-143 was expressed approximately 24-fold higher in heart, 17-fold higher in thymus, and 8-fold higher in kidney.

The mir-143 miRNA was also found to be expressed in adipocytes and preadipocytes, and levels of mir-143 were found to be dramatically upregulated in differentiated adipocytes as compared to preadipocytes, indicating that this miRNA may be important in adipocyte differentiation. These data, taken together with the finding that the oligomeric compound, ISIS Number 327901 (SEQ ID NO: 319), targeted to mir-143, was shown to inhibit the adipocyte differentiation markers (described above, Example 13), supports the conclusion that mir-143 is involved in cellular differentiation pathways.

Example 15

Effects of Oligomeric Compounds Targeting miRNAs on Apoptosis in the Caspase Assay in Preadipocytes The effect of oligomeric compounds of the present invention targeting miRNAs was examined in preadipocytes (Zen-Bio, Inc., Research Triangle Park, N.C.) using the fluorometric caspase assay previously described in Example 11. The oligonucleotide random-mer, ISIS-29848 (SEQ ID NO: 737) was used as a negative control, and ISIS-148715 (SEQ ID NO: 738), targeting the human Jagged2 mRNA, known to induce apoptosis when inhibited, was used as a positive control. The measurement obtained from the untreated control cells is designated as 100% activity and was set equal to 1.0. Results are shown in Table 19.

TABLE 19

Effects of targeting miRNAs on apoptosis in preadipocytes

| ISIS Number | SEQ ID NO. | Pri-miRNA | Fold Increase over UTC |
|---|---|---|---|
| UTC Untreated control | N/A | N/A | 1.0 |
| ISIS-29848 n-mer | 737 | N/A | 1.2 |
| ISIS-148715 Positive control | 738 | Jagged2 | 36.9 |
| 327888 | 306 | mir-108-1 | 1.1 |
| 327889 | 307 | mir-23b | 1.1 |
| 327890 | 308 | let-7i | 1.3 |

TABLE 19-continued

Effects of targeting miRNAs on apoptosis in preadipocytes

| ISIS Number | SEQ ID NO. | Pri-miRNA | Fold Increase over UTC |
|---|---|---|---|
| 327893 | 311 | let-7b | 1.3 |
| 327901 | 319 | mir-143 | 2.0 |
| 327903 | 321 | let-7a-3 | 1.6 |
| 327905 | 323 | mir-205 | 1.5 |
| 327919 | 337 | mir-221 | 1.3 |
| 327922 | 340 | mir-19b-2 | 1.0 |
| 327925 | 343 | mir-133b | 2.0 |
| 327926 | 344 | let-7d | 1.8 |
| 327930 | 348 | let-7e | 1.4 |
| 327931 | 349 | let-7c | 1.5 |
| 327934 | 352 | mir-213 | 2.0 |
| 327938 | 356 | mir-98 | 1.0 |
| 327939 | 357 | mir-125b-1 | 2.2 |
| 327941 | 359 | mir-181b | 1.3 |
| 327942 | 360 | mir-141 | 1.0 |
| 327955 | 373 | mir-130b | 4.3 |
| 327967 | 385 | let-7g | 1.5 |

From these data, it is evident that the oligomeric compounds of the present invention generally do not induce the activity of caspases involved in apoptotic pathways in preadipocytes. In particular, the oligomeric compound targeting mir-143, ISIS Number 327901 (SEQ ID NO: 319), does not result in a significant increase in caspase activity as compared to the Jagged2 positive control. Taken together with the results from the adipocyte differentiation assay (Example 13) and the expression analysis of mir-143 (Example 14), these data suggest that the mir-143 miRNA plays a role in stimulating cellular differentiation, employing pathways other than the caspase cascades activated during apoptosis.

It was recently reported that bone marrow cells may contribute to the pathogenesis of vascular diseases, and that cell differentiation appears to be important in models of postangioplasty restenosis, graft vasculopathy, and hyperlipidemia-induced atherosclerosis. Bone marrow cells have the potential to give rise to vascular progenitor cells that home in on damaged vessels and differentiate into smooth muscle cells or endothelial cells, thereby contributing to vascular repair, remodeling, and lesion formation (Sata, M. *Trends Cariovasc Med.* 2003 13(6):249-53). Thus, the ability to modulate cell differentiation may provide the basis for the development of new therapeutic strategies for vascular diseases, targeting mobilization, homing, differentiation, and proliferation of circulating vascular progenitor cells.

Example 16

Comparison of Effects of Oligomeric Compounds Targeting the mir-143 pri-miRNA or Mature mir-143 miRNA on Adipocyte Differentiation Two oligomeric compounds targeting the mature mir-143 miRNA and two oligomeric compounds targeting the 110-nucleotide mir-143 pri-miRNA were compared for their effects on adipocyte differentiation using the same adipocyte differentiation assay as described in Example 13.

The oligomeric compound, ISIS Number 327901 (SEQ ID NO: 319), 22-nucleotides in length, targets the mature mir-143 miRNA and is composed of 2'-methoxyethoxy (2'-MOE) nucleotides and phosphorothioate (P=S) internucleoside (backbone) linkages throughout. The oligomeric compound ISIS Number 338664 (CAGACTCCCAACTGACCAGA; SEQ ID NO: 491) is also a uniform 2'-MOE oligonucleotide, which is designed to target the mir-143 pri-miRNA. Another oligomeric compound targeting the mir-143 pri-miRNA, ISIS Number 328382 (SEQ ID NO: 491) is a chimeric oligonucleotide, 20 nucleotides in length, composed of a central "gap" region consisting of ten 2'-deoxynucleotides, which is flanked on both sides (5' and 3' directions) by five-nucleotide "wings" having 2'-MOE substituents in the wing nucleosides (a "5-10-5 gapmer"), and ISIS Number 340927 (TGAGCTA-CAGTGCTTCATCTCA; SEQ ID NO: 319) is a 5-10-7 gapmer designed to target mature mir-143. The internucleoside (backbone) linkages are phosphorothioate (P=S) throughout the oligonucleotide. All cytidine residues are 5-methylcytidines. The effect of these oligomeric compounds targeting the mir-143 miRNA and the mir-143 pri-miRNA on expression of the 5 hallmark genes indicating cellular differentiation was examined in preadipocytes using the same methods described in Example 13. Results are shown in Table 20.

TABLE 20

Comparison of uniform 2'-MOE and chimeric oligomeric compounds targeting the mir-143 miRNA and pri-miRNAs on expression of adipocyte differentiation markers

| ISIS Number | SEQ ID NO | TG | AP2 | HSL | Glut4 | PPAR gamma |
|---|---|---|---|---|---|---|
| 327901 | 319 | 0.54 | 0.42 | 0.33 | 0.19 | 0.30 |
| 328382 | 491 | 0.72 | 0.89 | 0.75 | 0.85 | 0.96 |
| 338664 | 491 | 1.42 | 1.01 | 0.76 | 1.81 | 0.86 |
| 340927 | 319 | 0.65 | 0.77 | 0.73 | 0.54 | 0.36 |

From these data, it was observed that while the gapmer oligomeric compound targeting the mature mir-143 (ISIS Number 340972) results in reduced expression of the adipocyte differentiation markers, the uniform 2'-MOE oligomeric compound targeting mature mir-143 (ISIS Number 327901) was more effective. For the oligomeric compounds targeting the mir-143 pri-miRNA, the gapmer compound (ISIS Number 328382) appeared to be more effective in blocking adipocyte differentiation than was the uniform 2'-MOE oligomeric compound (ISIS Number 338664).

Dose Responsiveness:

In one embodiment, the oligomeric compound ISIS Number 327901 (SEQ ID NO: 319) targeting mature mir-143 was selected for additional dose response studies in the adipocyte differentiation assay. Differentiating adipocytes (at day 10 post-induction of differentiation) were treated with 50, 100, 200, and 300 nM ISIS 327901, or the scrambled control ISIS Number 342673 (SEQ ID NO: 758) containing 15 mismatches with respect to the mature mir-143 miRNA. ISIS Numbers 327901 and 342673 are uniform 2'-MOE phosphorothioate oligomeric compounds 22 nucleotides in length. Differentiating adipocytes treated with ISIS Number 29848 (SEQ ID NO: 737) served as the negative control to which the data were normalized. Differentiating adipocytes treated with ISIS 105990 (SEQ ID NO: 759), a 5-10-5 gapmer oligomeric compound targeting the PPAR-gamma mRNA which has been demonstrated previously to inhibit adipocyte differentiation, served as the positive control. Triglyceride levels as well as mRNA levels for each of the four adipocyte differentiation hallmark genes (PPAR-gamma, aP2, HSL, and GLUT4) were measured 24 hours after treatment as described above. Untreated cells were compared to cells treated with oligomeric compounds, and results of these dose response studies are shown in Table 21, where levels of the markers is expressed as a percentage of untreated control (% UTC) levels. Where present, "N.D." indicates "no data."

TABLE 21

Effects of oligomeric compounds targeting mir-143 on expression of adipocyte differentiation markers

| Hallmark Measured: | Isis #: | % UTC Dose of oligomeric compound | | | |
|---|---|---|---|---|---|
| | | 50 nM | 100 nM | 200 nM | 300 nM |
| Triglycerides | 342673 negative control | 94.2 | 105.3 | 98.3 | 108.2 |
| | 105990 positive control | N.D. | N.D. | N.D. | 16.6 |
| | 327901 | 85.3 | 68.9 | 34.0 | 23.0 |
| PPAR-gamma mRNA | 342673 negative control | 77.5 | 89.9 | 94.6 | 85.8 |
| | 105990 positive control | N.D. | N.D. | N.D. | 43.9 |
| | 327901 | 74.6 | 70.8 | 51.8 | 39.3 |
| AP2 mRNA | 342673 negative control | 82.4 | 90.3 | 81.1 | 70.9 |
| | 105990 positive control | N.D. | N.D. | N.D. | 17.9 |
| | 327901 | 78.3 | 64.6 | 39.0 | 22.4 |
| HSL mRNA | 342673 negative control | 92.0 | 95.6 | 97.3 | 85.2 |
| | 105990 positive control | N.D. | N.D. | N.D. | 7.4 |
| | 327901 | 89.5 | 73.5 | 40.2 | 11.9 |
| GLUT4 mRNA | 342673 negative control | 94.9 | 90.7 | 97.6 | 102.7 |
| | 105990 positive control | N.D. | N.D. | N.D. | 11.8 |
| | 327901 | 74.2 | 49.7 | 32.8 | 17.4 |

From these data, it was that observed that treatment of differentiating adipocytes with the uniform 2'-MOE oligomeric compound, ISIS Number 327901 targeting mir-143 results in a dose responsive reduction of expression of all five markers of differentiation. Thus, this oligomeric compound may be useful in the treatment of diseases associated with increased expression of these hallmark genes, such as obesity, hyperlipidemia, atherosclerosis, atherogenesis, diabetes, hypertension, or other metabolic diseases as well as having potential applications in the maintenance of the pluripotent phenotype of stem or precursor cells.

Example 17

Human Let 7 Homologs

Let-7 is one of the two miRNAs originally identified in *C. elegans* as an antisense translational repressor of messenger RNAs encoding key developmental timing regulators in nematode larva. Several genes predicted to encode let-7-like miRNAs have been identified in a wide variety of species, and these let-7-like homologs are believed to control temporal transitions during development across animal phylogeny. Oligomeric compounds of the present invention were designed to target several human let-7-like genes. Additionally, a series of target-specific DNA oligonucleotide probes were synthesized by IDT (Coralville, Iowa) and used in Northern analyses to assess the expression of let-7-like miRNA homologs in various tissues. These let-7 homolog specific probes are shown in Table 22.

TABLE 22

Probes for Northern analyses of mRNA expression of let-7 homologs

| ISIS Number | SEQ ID NO | Sequence | pri-miRNA |
|---|---|---|---|
| 327890 | 308 | AGCACAAACTACTACCTCA | let-7i |
| 327893 | 311 | AACCACACAACCTACTACCTCA | let-7b |
| 327903 | 321 | AACTATACAACCTACTACCTCA | let-7a-3 |
| 327926 | 344 | ACTATGCAACCTACTACCTCT | let-7d |
| 327930 | 348 | ACTATACAACCTCCTACCTCA | let-7e |
| 327931 | 349 | AACCATACAACCTACTACCTCA | let-7c |
| 327967 | 385 | ACTGTACAAACTACTACCTCA | let-7g |

For Northern analyses with let-7 homolog probes, total RNA from spleen, kidney, testes, heart, and liver tissues as well as total RNA from HEK293, T47D, T-24, MCF7, HepG2, and K-562 Leukemia cell lines was either prepared as described above or purchased from Ambion, Inc. (Austin, Tex.). Northern blotting was performed as described above (Example 14). The let-7c miRNA was observed to be expressed in spleen, kidney, testes, heart and liver tissues, as well as in HEK293 and T47D cell lines. The let-7e miRNA was observed to be expressed in T-24, MCF7, T47D, 293T, HepG2, and K-562 cell lines.

In one embodiment, expression of let-7-like pri-miRNA homologs was detected in total RNA from brain, liver and spleen tissues, as well as total RNA from preadipocytes, differentiated adipocytes, and HeLa, HEK-293, and T-24 cell lines by real-time RT-PCR. Primer/probe sets were designed to distinguish between and amplify specific let-7-like pri-miRNA homologs. These primer/probe sets are shown in Table 23.

TABLE 23

Primer/probe sets for assaying expression of let-7 miRNA homologs

| Pri-miRNA | Primer or probe | Isis number | SEQ ID NO. | sequence |
|---|---|---|---|---|
| let-7b | forward | 341672 | 765 | GAGGTAGTAGGTTGTGTGGTTTCA |
| | reverse | 341673 | 766 | AGGGAAGGCAGTAGGTTGTATAGTT |
| | probe | 341674 | 767 | CAGTGATGTTGCCCCTCGGAAGA |
| let-7c | forward | 341675 | 768 | TGCATCCGGGTTGAGGTA |
| | reverse | 341676 | 769 | AGGAAAGCTAGAAGGTTGTACAGTTAA |
| | probe | 341677 | 770 | AGGTTGTATGGTTTAGAGTTACACCCTGGGA |

TABLE 23-continued

Primer/probe sets for assaying expression of let-7 miRNA homologs

| Pri-miRNA | Primer or probe | Isis number | SEQ ID NO. | sequence |
|---|---|---|---|---|
| let-7d | forward | 341678 | 771 | CCTAGGAAGAGGTAGTAGGTTGCA |
|  | reverse | 341679 | 772 | CAGCAGGTCGTATAGTTACCTCCTT |
|  | probe | 341680 | 773 | AGTTTTAGGGCAGGGATTTTGCCCA |
| let-7g | forward | 341681 | 774 | TTCCAGGCTGAGGTAGTAGTTTd |
|  | reverse | 341682 | 775 | TTATCTCCTGTACCGGGTGGT |
|  | probe | 341683 | 776 | ACAGTTTGAGGGTCTAT |
| let-7i | forward | 341684 | 777 | TGAGGTAGTAGTTTGTGCTGTTGGT |
|  | reverse | 341685 | 778 | AGGCAGTAGCTTGCGCAGTTA |
|  | probe | 341686 | 779 | TTGTGACATTGCCCGCTGTGGAG |
| let-7a-1 | forward | 341687 | 780 | GGATGAGGTAGTAGGTTGTATAGTTTTAGG |
|  | reverse | 341688 | 781 | CGTTAGGAAAGACAGTAGATTGTATAGTTATC |
|  | probe | 341689 | 782 | TCACACCCACCACTGG |
| let-7a-3 | forward | 341690 | 783 | GGGTGAGGTAGTAGGTTGTATAGTTTGG |
|  | reverse | 341691 | 784 | CACTTCAGGAAAGACAGTAGATTGTATAGTT |
|  | probe | 341692 | 785 | CTCTGCCCTGCTATGG |

Using these primer/probe sets, the let-7-like pri-miRNA homologs were found to be expressed in human brain, liver and spleen, as well as preadipocytes, differentiated adipocytes, and HeLa, T-24 and HEK-293 cells lines. In particular, the let-7b pri-miRNA exhibited approximately 100-fold higher expression in differentiated adipocytes as compared to preadipocytes. Furthermore, the let-7b, let-7c, let-7d, let-7i, and let-7a-3 pri-miRNAs were highly expressed in brain and spleen tissues.

In summary, the let-7-like homologs have been found to be widely expressed in various human tissues and several cell lines. Furthermore, some oligomeric compounds targeted to human let-7 pri-miRNAs generally appeared to result in the induction of cell differentiation, consistent with the functional role of let-7 as a regulator of developmental timing in nematode larva. Specifically, the oligomeric compounds targeted to let-7c (ISIS Number 327931; SEQ ID NO: 349) and let-7a-3 (ISIS Number 327903; SEQ ID NO: 321) resulted in an increase in expression levels for several markers of adipocyte differentiation. Furthermore, inhibition of the let-7-like homologs by oligomeric compounds of the present invention did not appear to induce caspases activated in apoptotic pathways (performed in Example 15). Thus, the oligomeric compounds of the present invention targeting let-7-like pri-miRNA homologs appear to stimulate adipocyte differentiation and do not promote cell death by apoptosis. Thus, the oligomeric compounds of the present invention may be useful as pharmaceutical agents in the treatment of anorexia or diseases, conditions or injuries in which the induction of cellular differentiation is desireable, such as Alzheimers disease or central nervous system injury, in which neural regeneration would be beneficial.

Example 18

Effects of Oligomeric Compounds Targeting miRNAs on Insulin Signaling in HepG2 Cells Insulin is secreted from pancreatic β-cells in response to increasing blood glucose levels. Through the regulation of protein expression, localization and activity, insulin ultimately stimulates conversion of excess glucose to glycogen, and results in the restoration of blood glucose levels. Insulin is known to regulate the expression of over 100 gene products in multiple cell types. For example, insulin completely inhibits the expression of hepatic insulin-like growth factor binding protein-1 (IGFBP-1), a protein which can sequester insulin-like growth factors, and phosphoenolpyruvate carboxykinase-cytosolic (PEPCK-c) which is a rate-controlling enzyme of hepatic gluconeogenesis. Levels of the follistatin mRNA are also believed to decrease in response to insulin treatment. IGFBP-1 and PEPCK-c are overexpressed in diabetes, and PEPCK-c overexpression in animals promotes hyperglycemia, impaired glucose tolerance and insulin-resistance. Thus, the IGFBP-1, PEPCK-c and follistatin genes serve as marker genes for which mRNA expression can be monitored and used as an indicator of an insulin-resistant state. Oligomeric compounds with the ability to reduce expression of IGFBP-1, PEPCK-c and follistatin are highly desirable as agents potentially useful in the treatment of diabetes and hypertension.

Oligomeric compounds of the present invention were tested for their effects on insulin signaling in HepG2 cells. HepG2 cells were plated at 7500 cells/well in collagen coated 96-well plates. The following day, cells were transfected with oligomeric compounds targeting miRNAs using 100 nM oligomeric compound in LIPOFECTIN™ (Invitrogen Corporation, Carlsbad, Calif.) in two 96-well plates. The oligomeric compounds were tested in triplicate on each 96-well plate, except for positive and negative controls, which were measured up to six times per plate. At the end of transfection, the transfection medium was replaced by regular growth medium. Twenty-eight hours post-transfection, the cells were subjected to overnight (sixteen to eighteen hours) serum starvation using serum free growth medium. Forty-four hours post-transfection, the cells in the transfected wells were treated with either no insulin ("basal" Experiment 1, for identification of insulin-mimetic compounds) or with 1 nM insulin ("insulin treated" Experiment 2, for identification of insulin sensitizers) for four hours. At the same time, in both plates, cells in some of the un-transfected control wells are treated with 100 nM insulin to determine maximal insulin response.

At the end of the insulin or no-insulin treatment (forty-eight hours post-transfection), total RNA is isolated from both the basal and insulin treated (1 nM) 96-well plates, and the amount of total RNA from each sample is determined using a Ribogreen assay (Molecular Probes, Eugene, Oreg.). Real-time PCR is performed on all the total RNA samples using primer/probe sets for three insulin responsive genes: PEPCK-c, IGFBP-1 and follistatin. Expression levels for each gene are normalized to total RNA, and values±standard deviation are expressed relative to the transfectant only untreated control (UTC) and negative control compounds. Results of these experiments are shown in Tables 24 and 25.

TABLE 24

Experiment 1: Effects of oligomeric compounds targeting miRNAs on insulin-repressed gene expression in HepG2 cells

| ISIS Number | SEQ ID NO | Pri-miRNA | IGFBP-1 (% UTC) | PEPCK-c (% UTC) | Follistatin (% UTC) |
|---|---|---|---|---|---|
| UTC | N/A | N/A | 100 | 100 | 100 |
| 29848 n-mer | 737 | N/A | 95 | 87 | 94 |
| 327876 | 294 | mir-29b-1 | 93 | 119 | 104 |
| 327878 | 296 | mir-203 | 162 | 45 | 124 |
| 327880 | 298 | mir-10b | 137 | 110 | 107 |
| 327889 | 307 | mir-23b | 56 | 137 | 56 |
| 327890 | 308 | let-7I | 99 | 85 | 78 |
| 327892 | 310 | mir-131-2/mir-9 | 108 | 75 | 91 |
| 327901 | 319 | mir-143 | 133 | 119 | 93 |
| 327903 | 321 | let-7a-3 | 71 | 71 | 60 |
| 327905 | 323 | mir-205 | 107 | 129 | 104 |
| 327913 | 331 | mir-29c | 123 | 229 | 115 |
| 327919 | 337 | mir-221 | 96 | 71 | 74 |
| 327922 | 340 | mir-19b-2 | 109 | 77 | 57 |
| 327925 | 343 | mir-133b | 152 | 145 | 110 |
| 327933 | 351 | mir-145 | 125 | 118 | 112 |
| 327934 | 352 | mir-213 | 231 | 99 | 140 |
| 327939 | 357 | mir-125b-1 | 125 | 125 | 104 |
| 327941 | 359 | mir-181b | 83 | 101 | 80 |
| 327954 | 372 | mir-148b | 118 | 79 | 100 |
| 338664 | 491 | mir-143 pri-miRNA | 90 | 75 | 93 |
| 340927 | 319 | mir-143 | 201 | 87 | 111 |

Under "basal" conditions (without insulin), treatments of HepG2 cells with oligomeric compounds of the present invention resulting in decreased mRNA expression levels of the PEPCK-c, IGFBP-1 and/or follistatin marker genes indicate that the oligomeric compounds have an insulin mimetic effect. Treatments with oligomeric compounds of the present invention resulting in an increase in mRNA expression levels of the PEPCK-c, IGFBP-1 and/or follistatin marker genes indicate that these compounds inhibit or counteract the normal insulin repression of mRNA expression of these genes.

From these data, it is evident that the oligomeric compounds, ISIS Number 327878 targeting mir-203 and ISIS Number 327922 targeting mir-19b-2, for example, result in a 55% and a 23% decrease, respectively, in PEPCK-c mRNA, a marker widely considered to be insulin-responsive. Thus, these oligomeric compounds may be useful as pharmaceutic agents comprising insulin mimetic properties in the treatment, amelioration, or prevention of diabetes or other metabolic diseases.

Conversely, the results observed with the oligomeric compound targeting mir-29c (ISIS Number 327913), for example, exhibiting increased expression of the IGFBP-1, PEPCK-c and follistatin marker genes, suggest that the mir-29c miRNA target may be involved in the regulation of these insulin-responsive genes. When the mir-29c miRNA is inactivated by an oligomeric compound, IGFBP-1, PEPCK-c and follistatin gene expression is no longer repressed.

TABLE 25

Experiment 2: Effects of oligomeric compounds targeting miRNAs on insulin-sensitization of gene expression in HepG2 cells

| ISIS Number | SEQ ID NO | Pri-miRNA | IGFBP-1 (% UTC) | PEPCK-c (% UTC) | Follistatin (% UTC) |
|---|---|---|---|---|---|
| UTC(1 nm insulin) | N/A | N/A | 100 | 100 | 100 |
| 29848 n-mer | 737 | N/A | 92 | 94 | 97 |
| 327876 | 294 | mir-29b-1 | 118 | 176 | 138 |
| 327878 | 296 | mir-203 | 185 | 29 | 150 |
| 327880 | 298 | mir-10b | 136 | 125 | 149 |
| 327890 | 307 | let-7i | 88 | 113 | 115 |
| 327892 | 308 | mir-131-2/mir-9 | 139 | 104 | 96 |
| 327901 | 310 | mir-143 | 135 | 117 | 135 |
| 327903 | 319 | let-7a-3 | 81 | 87 | 89 |
| 327905 | 321 | mir-205 | 115 | 147 | 148 |
| 327913 | 323 | mir-29c | 147 | 268 | 123 |
| 327919 | 331 | mir-221 | 154 | 105 | 178 |
| 327922 | 337 | mir-19b-2 | 104 | 76 | 61 |
| 327925 | 340 | mir-133b | 166 | 182 | 148 |
| 327933 | 343 | mir-145 | 179 | 115 | 185 |
| 327934 | 351 | mir-213 | 244 | 105 | 103 |
| 327939 | 352 | mir-125b-1 | 175 | 153 | 192 |
| 327941 | 357 | mir-181b | 80 | 98 | 68 |
| 327954 | 359 | mir-148b | 120 | 102 | 105 |
| 327889 | 372 | mir-23b | 73 | 202 | 72 |
| 338664 | 491 | mir-143 pri-miRNA | 100 | 76 | 84 |
| 340927 | 319 | mir-143 | 285 | 103 | 128 |

For HepG2 cells treated with 1 nM insulin, treatments with oligomeric compounds of the present invention resulting in a decrease in mRNA expression levels of the PEPCK-c, IGFBP-1 and/or follistatin marker genes indicate that these compounds have an insulin sensitization effect. Treatments with oligomeric compounds of the present invention resulting in an increase in mRNA expression levels of the PEPCK-c, IGFBP-1 and/or follistatin marker genes indicate that these compounds inhibit or counteract the normal insulin response of repression of mRNA expression of these genes.

From these data, it is evident that the oligomeric compounds, ISIS Number 327878 targeting mir-203 and ISIS Number 327922 targeting mir-19b-2, for example, were observed to result in a 71% and a 24% reduction, respectively, of PEPCK-c mRNA expression, widely considered to be a marker of insulin-responsiveness. Thus, these oligomeric compounds may be useful as pharmaceutic agents with insulin-sensitizing properties in the treatment, amelioration, or prevention of diabetes or other metabolic diseases.

Conversely, the results observed with the oligomeric compounds targeting mir-29c (ISIS Number 327913), mir-133b (ISIS Number 327925), and mir-125b-1 (ISIS Number 327939), all exhibiting increased expression of the IGFBP-1, PEPCK-c and follistatin marker genes, support the conclusion that the mir-29c, mir-133b, and mir-125b-1 miRNAs may be involved in the regulation of insulin-responsive genes. When these miRNAs are inactivated by the oligomeric compounds of the present invention, IGFBP-1, PEPCK-c and follistatin gene expression is no longer repressed or insulin-sensitive.

A caspase assay was also performed (as in Example 11 above) in HepG2 cells treated with oligomeric compounds of the present invention, and it was determined that oligomeric compounds targeting the mir-29c, mir-133b, and mir-125b-1 miRNAs were not toxic to the cells and that the observed reduction in mRNA expression levels of insulin-responsive genes was not due to a general toxicity of the compounds or an induction of apoptotic pathways.

Example 19

Analysis of Expression of mir-143 pri-miRNA and Mature mir-143

Ribonuclease Protection Assays:

The ribonuclease protection assay (RPA) is known in the art to be a sensitive and accurate method of measuring and/or following temporal changes in the expression of one or more RNA transcripts in a complex mixture of total RNA. Briefly, this method employs a radioactive probe that specifically hybridizes to a target transcript RNA. The probe is added to a sample of total RNA isolated from tissues or cells of interest, and, upon hybridization to its target, the probe forms a double-stranded RNA region. If the region of hybridization is shorter than the entire length of either the probe or the target RNA molecule, the molecule will be a hybrid molecule with partial double-stranded and partial single-stranded character. These hybrid molecules are then digested with single-strand-specific RNases such as RNase A and/or T1, which remove any non-hybridized single stranded portions of the hybrid molecules, leaving only the "protected" dsRNA fragments. The RNase protected fragments are then electrophoresed on a denaturing gel, causing the strands to dissociate, and the intensity of radioactive probe signal observed is directly proportional to the amount of specific target transcript RNA in the original total RNA sample.

In an embodiment of the present invention, small non-coding RNAs in a sample were detected by RPA using probes that hybridize to pri-miRNAs, pre-miRNAs or mature miRNAs. Probes were in vitro transcribed using the mirVana™ miRNA Probe Construction Kit (Ambion Inc., Austin, Tex.) according to the manufacturer's protocol, beginning with a DNA oligonucleotide representing sense strand of the mature miRNA to be detected plus four thymidylate residues plus an 8-base sequence complementary to the 3'-end of the T7 promoter primer supplied with the kit. When the T7 primer is annealed to this DNA oligonucleotide, the Klenow DNA polymerase is used to generate a double-stranded DNA, and then in vitro transcription is performed using the T7 RNA polymerase and radiolabeled nucleotides to generate a radioactive RNA probe for detection of the miRNA.

In one embodiment, a probe specifically hybridizing to the murine mir-143 miRNA was used in a RPA of 5 µg total RNA from kidney, liver, heart, lung, brain, spleen, and thymus tissues from mouse as well as adipose tissue from db/db obese mice, total RNA from an 11-day-old embryo, and total RNA from undifferentiated and differentiated 3T3-L 1 cells. All signals were normalized to the levels of 5.8S rRNA. Expression levels of mir-143 were highest in lung, heart, spleen, thymus and kidney tissues from wildtype mice. Notably, mir-143 expression levels were significantly elevated in adipose tissue from db/db mice (approximately 4 times higher than expression levels in kidney, 2.4 times higher than levels in heart and 1.6 times higher than levels in lung tissues from wildtype mice).

In one embodiment, a probe hybridizing to the mir-143 pri-miRNA molecule was ml used in a RPA of 2-5 µg total RNA from human spleen, thymus, testes, heart, liver, kidney, skeletal muscle, brain, lung and adipose tissues, as well as total RNA from preadipocytes, differentiated adipocytes, and HepG2 cells. A probe hybridizing to the β-actin mRNA was used as a control. The highest levels of mir-143 pri-miRNA were observed in heart, kidney, thymus and adipose tissues, as well as in differentiated adipocytes.

In one embodiment, a probe hybridizing to the mature mir-143 miRNA was also used in a RPA of 2 µg total RNA from human spleen, thymus, heart, liver, kidney and brain, tissues, as well as total RNA from preadipocytes, differentiated adipocytes, and total RNA from HepG2, A549, T-24, HEK293, HuVEC (human umblical vein endothelial cells), HL-60 and T47D cell lines. A probe hybridizing to the β-actin mRNA was used as a control, and all signals were normalized to the levels of mir-143 expression in preadipocytes. The results are shown in Table 26.

TABLE 26

RNase protection of mature mir-143 in total RNA from tissues and cell lines

| Tissue or cell line | Fold Increase over preadipocytes |
| --- | --- |
| Spleen | 2.6 |
| Thymus | 3.8 |
| Heart | 8.2 |
| Liver | 0 |
| Kidney | 10.0 |
| Brain | 0.9 |
| Preadipocytes | 1.0 |
| Differentiated adipocytes | 2.6 |
| HepG2 | 0.5 |
| A549 | N.D. |
| T-24 | 0.4 |
| HEK293 | 0.5 |
| HuVEC | 0.3 |
| HL-60 | 0.4 |
| T47D | 0.3 |

From these data, the highest levels of expression of the mature mir-143 miRNA were observed in total RNA from kidney and heart tissues. High levels of expression of the mature mir-143 miRNA were also observed in total RNA from lymphoid tissues such as spleen and thymus. Expression of the mature mir-143 miRNA is increased in differentiated adipocytes as compared to levels in preadipocytes. These data also suggest that the mir-143 miRNA plays a role in cellular differentiation.

In one embodiment, a uniform 2'-MOE phosphorothioate oligomeric compound with a sequence antisense to the mature mir-143 miRNA was spiked into the RPA mixture above. This antisense mir-143 compound was found to block the ribonuclease protection expression pattern previously observed, suggesting that this antisense mir-143 oligomeric compound specifically hybridizes to and inhibits the activity of mir-143. This oligomeric compound targeting the mir-143 miRNA is predicted to form a double stranded molecule that blocks endogenous mir-143 miRNA activity when employed in vivo.

It was also noted that, while expression of the mir-143 miRNA can be detected in non-transformed cells, such as HuVECs, in general, transformed cell lines have not been observed to exhibit high levels expression of mir-143. When taken together with the observation that the mir-143 miRNA is upregulated as adipocytes differentiate as well as the observation that oligomeric compounds targeting mir-143 inhibit adipocyte differentiation, these data suggest that mir-143 normally promotes adipocyte differentiation and mir-143 may have an inhibitory effect on cellular transformation that is consistent with its role in promoting cellular differentiation. Lack of expression or downregulation of mir-143 in transformed cell lines may be a cause or consequence of the undifferentiated state. Thus, mir-143 mimics may be useful as pharmaceutical agents in the treatment of hyperproliferative disorders such as cancer.

In one embodiment, the expression of human mir-143 was assessed during adipocyte differentiation. A probe hybridizing to the human mir-143 miRNA was used in a RPA of 5 μg total RNA from pre-adipocytes, and differentiated adipocytes sampled at one, four, and ten days post-differentiation. All signals were normalized to the levels of 5.8S rRNA. mir-143 expression levels were 2.5 to 3-fold higher by day 10 post-differentiation when compared to mir-143 expression levels in pre-adipocytes by ribonuclease protection assay. Real-time RT-PCR analysis of mir-143 pri-miRNA expression:

Expression levels of mir-143 pri-miRNA were compared in total RNAs from various tissues and total RNA from several cell lines. Total RNA from spleen, heart, liver, and brain tissues, as well as total RNA from preadipocytes, differentiated adipocytes, and HepG2, T-24 and HeLa cell lines was purchased or prepared as described supra. 80 ng of total RNA from each source was used to perform real-time RT-PCR using a primer/probe set specific for the mir-143 pri-miRNA molecule. ISIS 339314 (TCCCAGCCTGAGGTGCA; SEQ ID NO: 786) was used as the forward primer, ISIS 342897 (GCTTCATCTCAGACTCCCAACTG; SEQ ID NO: 787) was used as the reverse primer, and ISIS 342898 (TGCTG-CATCTCTG; SEQ ID NO: 788) was used as the probe. RNA levels from all sources were compared to RNA levels from preadipocytes. Greater than 32-fold higher levels of mir-143 pri-miRNA were observed in heart tissue as compared to preadipocytes; 19-fold higher levels of mir-143 pri-miRNA were observed in differentiated adipocytes relative to levels in preadipocytes; 5-fold higher levels of mir-143 pri-miRNA were observed in spleen as compared to preadipocytes.

Northern blot analyses were performed in differentiating adipocytes as described in Example 14 using the mir-143-specific DNA oligonucleotide probe (SEQ ID NO: 319) to detect the mir-143 target and a probe for the U6 RNA to normalize for variations in loading and transfer efficiency, and it was confirmed by Northern analysis that expression of mature mir-143 increases from day 1 through day 10 after induction of differentiation.

In human pre-adipocytes and adipocytes sampled one, four, seven and ten days post-differentiation, expression levels of mir-143 pri-miRNA were also assessed using real-time RT-PCR analysis as described herein. 80 ng of total RNA from pre-adipocytes or differentiated adipocytes was used to perform real-time RT-PCR using the same primer/probe set specific for the mir-143 pri-miRNA molecule described supra (ISIS 339314, SEQ ID NO: 786 was used as the forward primer, ISIS 342897, SEQ ID NO: 787 was used as the reverse primer, and ISIS 342898, SEQ ID NO: 788 was used as the probe). RNA levels from all sources were normalized to 5.8S rRNA levels. mir-143 pri-miRNA levels in preadipocytes were 94% of the level of the 5.8S rRNA. At day 1 post-differentiation, mir-143 pri-miRNA levels had decreased to 38% of the level of the 5.8S rRNA. By day 4 post-differentiation, mir-143 pri-miRNA levels had decreased to 26%, by day 7 post-differentiation, mir-143 pri-miRNA levels were at 25%, and by day 10 post-differentiation, mir-143 pri-miRNA levels had dropped to 23% of the level of the 5.8S rRNA. Taken together with the results from RPA analysis, it appears that levels of the mature mir-143 miRNA increases approximately 2- to 3-fold by day 10 post-differentiation in differentiated adipocytes, accompanied by a concomittant approximately 4-fold decrease in the levels of unprocessed mir-143 pri-miRNA, indicating that adipocyte differentiation coincides with either an increase in processing of the mir-143 miRNA from the mir-143 pri-miRNA or an overall decrease in mir-143 pri-miRNA production.

Effects of Oligomeric Compounds on Expression of pri-miRNAs:

Mature miRNAs originate from long endogenous primary transcripts (pri-miRNAs) that are often hundreds of nucleotides in length. It is believed that a nuclear enzyme in the RNase III family, known as Drosha, processes pri-miRNAs (which can range in size from about 110 nucleotides up to about 450 nucleotides in length) into pre-miRNAs (from about 70 to 110 nucleotides in length) which are subsequently exported from the nucleus to the cytoplasm, where the pre-miRNAs are processed by human Dicer into double-stranded intermediates resembling siRNAs, which are then processed into mature miRNAs. Using the real-time RT-PCR methods described herein, the expression levels of several pri-miRNAs were compared in differentiating adipocytes. Total RNA from preadipocytes and differentiating adipocytes was prepared as described herein.

In one embodiment, modified oligomeric compounds can be transfected into preadipocytes or other undifferentiated cells, which are then induced to differentiate (as described in detail, herein), and it can be determined whether these modified oligomeric compounds act to inhibit or promote cellular differentiation. Real-time RT-PCR methods can then be used to determine whether modified oligomeric compounds targeting miRNAs can affect the expression or processing of the pre-miRNAs from the pri-miRNA (by the Drosha enzyme), the processing of the mature miRNAs from the pre-miRNA molecules (by the Dicer enzyme), or the RISC-mediated binding of a miRNA to its target nucleic acid.

Here, oligomeric compounds targeting mir-143 were transfected into preadipocytes which were then induced to differentiate, in order to assess the effects of these compounds on mir-143 pri-miRNA levels during differentiation. mir-143 pri-miRNA levels were assessed on days 3 and 9 after differentiation.

In addition to the uniform 2'-MOE phosphorothioate oligomeric compound ISIS Number 327901 (SEQ ID NO: 319) targeting mature mir-143, a 5-10-7 gapmer oligomeric compound, ISIS Number 340927 (SEQ ID NO: 319), was designed to target mature mir-143. As negative controls, "scrambled" oligomeric compounds were also designed; ISIS Number 342672 (ATACCGCGATCAGTGCATCTTT; incorporated herein as SEQ ID NO: 789) contains 13 mismatches with respect to the mature mir-143 miRNA, and ISIS Number 342673 (SEQ ID NO: 758) contains 15 mismatches with respect to the mature mir-143 miRNA. ISIS 342672 and ISIS 342673 are uniform 2'-MOE phosphorothioate oligomeric compounds 22 nucleotides in length. ISIS Number 342677 (SEQ ID NO: 789) and ISIS Number 342678 (SEQ ID NO: 758) are the corresponding 5-10-7 scrambled 2'-MOE gapmer oligomeric compounds. All cytidine residues are 5-methylcytidines. Additionally, ISIS Number 342683 (CCTTC-CCTGAAGGTTCCTCCTT; herein incorporated as SEQ ID NO: 790), representing the scrambled sequence of an unrelated PTP 1 B antisense oligonucleotide, was also used as a negative control.

These compounds were transfected into differentiating adipocytes and their effects on levels of the mir-143 pri-miRNA molecule were assessed in pre-adipocytes vs. differentiated adipocytes, by real-time RT-PCR using the primer/probe set specific for the mir-143 pri-miRNA (forward primer=ISIS 339314, SEQ ID NO: 786; reverse primer=ISIS 342897, SEQ ID NO.: 787; probe=ISIS 342898, SEQ ID NO.: 788). Thus, it was observed that in the presence of the oligomeric compound ISIS Number 327901 (SEQ ID NO: 319), levels of the mir-143 pri-miRNA are enhanced approximately 4-fold in differentiated adipocytes 9 days post-differentiation as compared to 3 days post-differentiation. These results suggest that ISIS Number 327901, the uniform 2'-MOE P=S oligomeric compound targeted to mature mir-143, interferes with the processing of the mir-143 pri-miRNA into the pre-miRNA by the Drosha RNase III enzyme. Alternatively, the compound interferes with the processing of the mir-143 pre-miRNA into the mature mir-143 miRNA by the Dicer enzyme. The decrease in levels of mature mir-143 miRNA in differentiating cells treated with ISIS Number 327901 (SEQ ID NO: 319) may also trigger a feedback mechanism that signals these cells to increase production of the mir-143 pri-miRNA molecule. Not mutually exclusive with the processing interference or the feedback mechanisms is the possibility that treatment with oligomeric compounds could stimulate the activity of an RNA-dependent RNA polymerase (RdRP) that amplifies the mir-143 pri-miRNA or pre-miRNA molecules. Oligomeric compounds of the present invention are predicted to disrupt pri-miRNA and/or pre-miRNA structures, and sterically hinder Drosha and/or Dicer cleavage, respectively. Furthermore, oligomeric compounds which are capable of binding to the mature miRNA are also predicted to prevent the RISC-mediated binding of a miRNA to its target nucleic acid, either by cleavage or steric occlusion of the miRNA.

Example 20

Identification of RNA Transcripts Bound by miRNAs

The RACE-PCR method (Rapid Amplification of cDNA Ends) was used as a means of identifying candidate RNA transcripts bound and/or potentially regulated by miRNAs. RNA was prepared and isolated from preadipocytes, and, using the SMART RACE cDNA Amplification kit (BD Biosciences, Clontech, Palo Alto, Calif.) according to manufacturer's protocol, synthetic adaptor sequences were incorporated into both the 5'- and 3'-ends of the amplified cDNAs during first strand cDNA synthesis. 5' RACE-PCR was then performed using the mature miRNA as the 3'-end primer along with the 5' adapter primer from the kit to amplify the 5'-end of the candidate RNA transcript. 3' RACE-PCR was performed using the antisense sequence of the miRNA as a primer along with the 3' adapter primer from the kit to amplify the 3'-end of the candidate RNA transcript. In some embodiments, the primers 2-nucleotides shorter than the corresponding miRNA were used in order to identify targets with some mismatching nucleotides at the end of the miRNA (these primers are indicated by "3'-RACE-2nt" in Table 27 below).

For example, the antisense sequences of the mature mir-43, let-7g, mir-23b, mir-29c, mir-131, mir-143, mir-130b and mir-213 miRNAs were used as primers in 3' RACE-PCR, and the mature mir-143 or mir-15a sequences were used in 5' RACE-PCR. The RACE-PCR products employing the mir-143 miRNA, the mir-143 antisense sequence, the mir-131 antisense sequence or the mir-15a miRNA as primers were electrophoresed and gel purified, prominent bands were excised from the gel, and these products were subcloned using standard laboratory methods. The subcloned products from the RACE-PCR were then were sent to Retrogen, Inc. (San Diego, Calif.) for sequencing. Candidate RNA transcripts targeted by miRNAs were thereby identified.

Candidate RNA targets identified by RACE-PCR methods are shown in Table 27, where the miRNA-specific primer used to identify each transcript is indicated in the column entitled "primer". (In some cases, the target was identified multiple times by more than one RACE-PCR method, and thus appears in the table more than once).

TABLE 27

Predicted RNA targets of mir-143

| Primer | Method | GenBank Accession | RNA transcript targeted by miRNA | SEQ ID NO |
|---|---|---|---|---|
| mir-143 | 5'RACE | NM_001753.2 | caveolin 1, caveolae protein, 22 kDa | 791 |
| mir-143 | 5'RACE | NM_004652.1 | ubiquitin specific protease 9, X-linked (fat facets-like, Drosophila) | 792 |
| mir-143 | 5'RACE | NM_007126.2 | valosin-containing protein | 793 |
| mir-143 | 5'RACE | NM_000031.1 | aminolevulinate, delta-, dehydratase | 794 |
| mir-143 | 5'RACE | NM_007158.1 | NRAS-related gene | 795 |
| mir-143 | 5'RACE | NM_015396.1 | HSPC056 protein | 796 |
| mir-143 | 5'RACE | NM_001219.2 | calumenin | 797 |
| mir-143 | 5'RACE | BC051889.1 | RNA binding motif, single stranded interacting protein 1 | 798 |
| mir-143 | 5'RACE | BX647603.1 | Homo sapiens mRNA; cDNA DKFZp686L01105 (from clone DKFZp686L01105) | 799 |
| mir-143 | 5'RACE | AB051447.1 | KIAA1660 protein | 800 |
| mir-143 | 5'RACE | NM_007222.1 | zinc-fingers and homeoboxes 1 | 801 |
| mir-143 | 5'RACE | NM_001855.1 | collagen, type XV, alpha 1 | 802 |
| mir-143 | 3'RACE | NM_007222.1 | zinc-fingers and homeoboxes 1 | 801 |
| mir-143 | 3'RACE | NM_006732 | FBJ murine osteosarcoma viral oncogene homolog B | 803 |
| mir-143 | 3'RACE | NM_003718.2 | cell division cycle 2-like 5 (cholinesterase-related cell division controller) | 804 |
| mir-143 | 3'RACE | NM_005626.3 | splicing factor, arginine/serine-rich 4 | 805 |
| mir-143 | 3'RACE | NM_002355.1 | mannose-6-phosphate receptor (cation dependent) | 806 |
| mir-143 | 3'RACE | NM_000100.1 | cystatin B (stefin B) | 807 |

TABLE 27-continued

Predicted RNA targets of mir-143

| Primer | Method | GenBank Accession | RNA transcript targeted by miRNA | SEQ ID NO |
|---|---|---|---|---|
| mir-143 | 3'RACE | NM_015959.1 | CGI-31 protein | 808 |
| mir-143 | 3'RACE | NM_006769.2 | LIM domain only 4 | 809 |
| mir-143 | 3'RACE | NM_003184.1 | TAF2 RNA polymerase II, TATA box binding protein (TBP)-associated factor, 150 kDa | 810 |
| mir-143 | 3'RACE | NM_025107.1 | myc target in myeloid cells 1 | 811 |
| mir-143 | 3'RACE | NM_003113.1 | nuclear antigen Sp100 | 812 |
| mir-143 | 3'RACE | NM_002696.1 | polymerase (RNA) II (DNA directed) polypeptide G | 813 |
| mir-143 | 3'RACE | NM_004156.1 | protein phosphatase 2 (formerly 2A), catalytic subunit, beta isoform | 814 |
| mir-143 | 3'RACE | NM_031157 | heterogeneous nuclear ribonucleoprotein A1 | 815 |
| mir-143 | 3'RACE | NM_004999.1 | myosin VI | 817 |
| mir-143 | 3'RACE | NM_018036.1 | chromosome 14 open reading frame 103 | 818 |
| mir-143 | 3'RACE | NM_018312.2 | chromosome 11 open reading frame 23 | 819 |
| mir-143 | 3'RACE | NM_002950.1 | ribophorin I | 820 |
| mir-143 | 3'RACE | NM_006708.1 | glyoxalase I | 821 |
| mir-143 | 3'RACE | NM_014953.1 | mitotic control protein dis3 homolog | 822 |
| mir-143 | 3'RACE | NM_004926.1 | zinc finger protein 36, C3H type-like 1 | 823 |
| mir-143 | 3'RACE | NM_004530.1 | matrix metalloproteinase 2 (gelatinase A, 72 kDa gelatinase, 72kDa type IV collagenase) | 824 |
| mir-143 | 3'RACE | NM_015208.1 | KIAA0874 protein | 825 |
| mir-143 | 3'RACE | NM_002582.1 | poly (A)-specific ribonuclease (deadenylation nuclease) | 826 |
| mir-143 | 3'RACE | NM_000297.2 | polycystic kidney disease 2 (autosomal dominant) | 827 |
| mir-143 | 3'RACE | NM_001175 | Rho GDP dissociation inhibitor (GDI) beta | 828 |
| mir-143 | 3'RACE | XM_166529 | glucocorticoid induced transcript 1, GLCCI1 | 837 |
| mir-143 | 3'RACE -2nt | NM_001753.2 | caveolin 1, caveolae protein, 22 kDa | 791 |
| mir-143 | 3'RACE -2nt | NM_006732 | FBJ murine osteosarcoma viral oncogene homolog B | 803 |
| mir-143 | 3'RACE -2nt | NM_000100.1 | cystatin B (stefin B) | 807 |
| mir-143 | 3'RACE -2nt | NM_015959.1 | CGI-31 protein | 808 |
| mir-143 | 3'RACE -2nt | NM_004156.1 | protein phosphatase 2 (formerly 2A), catalytic subunit, beta isoform | 814 |
| mir-143 | 3'RACE -2nt | NM_031157 | heterogeneous nuclear ribonucleoprotein A1 | 815 |
| mir-143 | 3'RACE -2nt | NM_002582.1 | poly(A)-specific ribonuclease (deadenylation nuclease) | 826 |
| mir-143 | 3'RACE -2nt | NM_000297.2 | polycystic kidney disease 2 (autosomal dominant) | 827 |
| mir-143 | 3'RACE -2nt | NM_006325.2 | RAN, member RAS oncogene family | 829 |
| mir-143 | 3'RACE -2nt | NM_004627.1 | tryptophan rich basic protein | 830 |
| mir-143 | 3'RACE -2nt | NM_012210.1 | tripartite motif-containing 32 | 831 |
| mir-143 | 3'RACE -2nt | AJ131244.1 | SEC24 related gene family, member A (S. cerevisiae) | 832 |
| mir-143 | 3'RACE -2nt | NM_031267.1 | cell division cycle 2-like 5 (cholinesterase-related cell division controller) | 833 |
| mir-143 | 3'RACE -2nt | AL049367.1 | guanine nucleotide binding protein (G protein), gamma 12 | 835 |
| mir-143 | 3'RACE -2nt | NM_001344 | defender against cell death 1 | 836 |
| mir-131 | 3'RACE | AK001214.1 | hypothetical protein FLJ10352 | 1735 |
| mir-131 | 3'RACE | NM_001614 | actin, gamma 1 (ACTG1), mRNA | 1736 |
| mir-131 | 3'RACE | NM_001948.1 | dUTP pyrophosphatase (DUT), mRNA | 1737 |
| mir-131 | 3'RACE | NM_002387.1 | mutated in colorectal cancers (MCC), mRNA | 1738 |
| mir-131 | 3'RACE | NM_004109.1 | ferredoxin 1 (FDX1), nuclear gene encoding mitochondrial protein, mRNA | 1739 |
| mir-131 | 3'RACE | NM_004342.4 | caldesmon 1 (CALD1), transcript variant 2, mRNA | 1740 |

TABLE 27-continued

Predicted RNA targets of mir-143

| Primer | Method | GenBank Accession | RNA transcript targeted by miRNA | SEQ ID NO |
|---|---|---|---|---|
| mir-131 | 3'RACE | NM_005572.2 | lamin A/C (LMNA), transcript variant 2, mRNA | 1741 |
| mir-131 | 3'RACE | NM_015640.1 | PAI-1 mRNA-binding protein (PAI-RBP1), mRNA | 1742 |
| mir-131 | 3'RACE | NM_017789.1 | semaphorin 4C (SEMA4C), mRNA | 1743 |
| mir-131 | 3'RACE | NM_144697.1 | hypothetical protein BC017397 (LOC148523), mRNA | 1744 |
| mir-131 | 3'RACE | NM_173710 | NADH dehydrogenase 3 (MTND3), mRNA | 1745 |
| mir-15a | 5'RACE | AF220018.1 | Homo sapiens tripartite motif protein (TRIM2) mRNA | 1746 |
| mir-15a | 5'RACE | M98399.1 | Human antigen CD36 mRNA | 1747 |
| mir-15a | 5'RACE | Y00281.1 | Human mRNA for ribophorin I | 1748 |

Because these RNA transcripts in Table 27 were identified as being bound by one of the mir-143, mir-131, or mir-15a miRNAs, these miRNAs are predicted to serve a regulatory role in expression or activity of these transcripts identified by RACE-PCR. Additional candidate human RNA targets can be identified in the same manner.

Example 21

Effects of Oligomeric Compounds on Adipocyte Differentiation Hallmark Genes in Differentiated Adipocytes The effect of the oligomeric compounds of the present invention targeting miRNAs on the expression of markers of cellular differentiation was examined in differentiated adipocytes.

The effects of the oligomeric compounds of the present invention on the hallmark genes known to be upregulated during adipocyte differentiation assayed in Example 13 were also assayed in differentiated adipoctyes. As previously described, the HSL, aP2, Glut4, and PPARγ genes play important rolls in the uptake of glucose and the metabolism and utilization of fats. Also as previously described, an increase in triglyceride content is another well-established marker for adipocyte differentiation. Human white preadipocytes (Zen-Bio Inc., Research Triangle Park, N.C.) were grown in preadipocyte media (ZenBio Inc.). After the cells reached confluence (approximately three days), they were exposed to differentiation media (Zen-Bio, Inc.) containing a PPAR-γ agonist, IBMX, dexamethasone, and insulin for three days. Cells were then fed Adipocyte Medium (Zen-Bio, Inc.), which was replaced at 2 to 3 day intervals. One day before transfection, 96-well plates were seeded with 3000 cells/well. Cells were then transfected on day nine post-differentiation, according to standard published procedures with 250 nM oligonucleotide in LIPOFECTIN™ (Invitrogen Corporation, Carlsbad, Calif.) (Monia et al., J. Biol. Chem. 1993 268(19): 14514-22). Oligomeric compounds were tested in triplicate on each 96-well plate, and the effect of TNF-α, known to inhibit adipocyte differentiation, was also measured in triplicate. Oligomeric compound treatments and transfectant-only negative controls may be measured up to six times per late. On day twelve post-differentiation, cells were washed and lysed at room temperature, and the expression of the four hallmark genes, HSL, aP2, Glut4, and PPARγ, as well as glyceride (TG) accumulation were measured in adipocytes transfected with the uniform 2'-MOE phosphorothioate (PS) previously described in Example 13 as well as the chimeric gapmer oligomeric compounds targeting the mir-143 miRNA and the mir-143 pri-miRNA described in Example 16. On day twelve post-differentiation, cells were lysed in a guanadinium-containing buffer and total RNA was harvested. The amount of total RNA in each sample was determined using a Ribogreen Assay (Molecular Probes, Eugene, Oreg.). Real-time PCR was performed on the total RNA using primer/probe sets for the adipocyte differentiation hallmark genes Glut4, HSL, aP2, and PPARγ. Triglyceride levels as well as mRNA levels for each of the four adipocyte differentiation hallmark genes are expressed relative to control levels (control=treatment with ISIS-29848 (SEQ ID NO: 737)). The results of this experiment are shown in Table 28.

TABLE 28

Effects of oligomeric compounds targeting miRNAs on expression of adipocyte differentiation markers

| ISIS Number | SEQ ID NO | TG | aP2 | HSL | Glut4 | PPAR gamma |
|---|---|---|---|---|---|---|
| 327876 | 294 | 1.16 | 0.67 | 0.81 | 3.53 | 1.28 |
| 327878 | 296 | 1.08 | 0.13 | 0.19 | 0.17 | 0.85 |
| 327880 | 298 | 1.12 | 1.14 | 0.93 | 0.76 | 1.86 |
| 327888 | 306 | 1.13 | 0.73 | 0.84 | 0.56 | 1.69 |
| 327889 | 307 | 1.09 | 1.12 | 0.77 | 0.99 | 1.63 |
| 327890 | 308 | 1.13 | 0.35 | 0.42 | 0.37 | 1.05 |
| 327892 | 310 | 1.23 | 0.81 | 0.62 | 0.42 | 1.01 |
| 327901 | 319 | 1.12 | 1.28 | 1.47 | 2.20 | 1.34 |
| 327903 | 321 | 1.12 | 0.56 | 0.53 | 0.36 | 0.91 |
| 327905 | 323 | 1.18 | 0.85 | 0.65 | 0.58 | 1.31 |
| 327913 | 331 | 1.12 | 1.05 | 1.09 | 1.52 | 1.29 |
| 327919 | 337 | 1.15 | 1.20 | 0.83 | 1.82 | 1.80 |
| 327922 | 340 | 1.48 | 0.91 | 1.01 | 0.61 | 0.99 |
| 327925 | 343 | 1.33 | 0.78 | 1.20 | 0.74 | 1.30 |
| 327933 | 351 | 1.63 | 1.58 | 1.30 | 2.12 | 1.60 |
| 327934 | 352 | 1.43 | 1.50 | 1.97 | 1.52 | 1.54 |
| 327939 | 357 | 1.33 | 1.16 | 1.08 | 0.72 | 1.89 |
| 327941 | 359 | 1.33 | 0.90 | 1.17 | 0.90 | 1.66 |
| 327954 | 372 | 1.46 | 1.23 | 1.35 | 0.61 | 1.46 |
| 328382 | 491 | 1.33 | 0.92 | 0.53 | 0.75 | 0.97 |
| 338664 | 491 | 1.72 | 0.77 | 1.01 | 1.08 | 1.06 |
| 340927 | 319 | 1.61 | 0.71 | 0.64 | 0.96 | 1.21 |

From these data, it was observed that the compound targeting the mir-203 miRNA (ISIS Number 327878), exhibited a sustained reduction in the hallmark marker genes at the 12$^{th}$ day post differentiation. Treatment with this compound resulted in decreased expression of the aP2, HSL, Glut4 and PPARγ marker genes, indicating that this oligomeric compound may lead to reduced levels of mobilization of fatty acids from adipose tissue, and has the potential to ameliorate some of the symptoms of type 2 diabetes, obesity, hypertension, atherosclerosis, cardiovascular disease, insulin resistance, and certain cancers. Notably, the effect of treatment of differentiated adipocytes with this oligomeric compound targeting the mir-203 miRNA mirrors the effect of treating cells with the TNF-α positive control that inhibits adipocyte differentiation. This evidence suggests that the oligomeric compound targeting the mir-203 miRNA can act as a TNF-α mimetic compound, and potentially may be used in the suppression of cellular differentiation and the maintenance of cells in a quiescent state.

The oligomeric compound targeting the mir-203 miRNA was also tested in the insulin assay (see Example 18) and was observed to reduce expression of PEPCK-c, indicating that it may also be useful as an insulin mimetic and/or antidiabetic drug.

As an extension of these conclusions, one having ordinary skill in the art would appreciate that further modified oligomeric compounds could be designed to also target the mir-203 mature miRNA, or the pri-miRNA and pre-miRNA precursors. Such compounds are noted to be within the scope of the present invention.

Example 22

Effects of Oligomeric Compounds on Lymphocytic Leukemia Cells

Mir15-a-1 and mir-16-3 have been recently shown to reside in human chromosomal region (13q14) that is deleted in about 50% of chronic lymphocytic leukemia (CLL) patients. Mir-15 and 16 were found to be down-regulated in about 68% of CLL cases (Calin et al., Proc. Natl. Acad. Sci. USA, 2002, 99, 15524-15529, which is incorporated herein by reference in its entirety). CLL B-cells develop chemotherapy resistance over time, possibly due to a defective apoptosis pathway.

Using the 5'RACE method (described in Example 20), the CD36 mRNA was identified as one target regulated by mir-15 and/or mir-16 miRNAs. CD36 is a scavenger receptor involved in fat uptake by macrophages and adipocytes. CD36 is reported to be upregulated in some CLL cell lines, and its expression may correlate with tumor invasiveness.

If the apoptosis pathway is defective and the deletion or down-regulation of mir-15 and/or mir-16 play a role in CLL chemo-resistance, then addition of mir-15 and/or mir-16 should be able to induce apoptosis in CLL and increase drug-induced apoptosis. RNA oligonucleotide molecules ISIS Number 338963 (TAGCAGCACATAATGGTTTGTG; SEQ ID NO: 269) representing mir-15a-1/mir-15a-2, ISIS Number 338961 (TAGCAGCACATCATGGTTTACA; SEQ ID NO: 246) representing mir-15b, and ISIS Number 338965 (TAGCAGCACGTAAATATTGGCG; SEQ ID NO: 196) representing mir-16-1/mir-16-2/mir-16-3 were synthesized and deprotected. Additionally, RNA oligonucleotides bearing imperfect complementarity to these miRNA mimics (mimicking the imperfect complementarity found in the pri-miRNA) were also synthesized and deprotected. These imperfect complements were ISIS Number 338964 (TGCAGGCCATATTGTGCTGCCT; SEQ ID NO: 840), which is partially complementary to ISIS Number 338963 and represents the imperfect complement of mir-15a-1/mir-15a-2; ISIS Number 338962 (TGCGAATCATTATTTGCTGCTC; SEQ ID NO: 841), which is partially complementary to ISIS Number 338961 and represents the imperfect complement of mir-15b; ISIS Number 338966 (CTCCAGTATTAACTGTGCTGCTG; SEQ ID NO: 842), which is partially complementary to ISIS Number 338965 and represents the imperfect complement of mir-16-1 and mir-16-2; and ISIS Number 338967 (CACCAATATTACTGTGCTGCTT; SEQ ID NO: 843), which is partially complementary to ISIS Number 338965 and represents the imperfect complement of mir-16-3. These RNA molecules were diluted in water, and the concentration determined by $A_{260}$. Equimolar amounts of each of the miRNAs and their imperfect complementary RNA sequences were mixed together in the presence of Dharmacon 5X Universal buffer to form four "natural" double-stranded miRNA mimics. ISIS Number 338965 (SEQ ID NO: 196) was used twice; once, it was hybridized to ISIS Number 338966, and once it was hybridized to ISIS Number 338967, to form two different "natural" double-stranded miRNA mimics, Mir-16-1/Mir-16-2 and Mir-16-3, with imperfect complementarity. The mixture of four "natural" miRNA mimics was incubated for 1-5 minutes at 90° C. (the time depends on the volume of the mixture) and then incubated at 37° C. for one hour. $A_{260}$ readings were taken on the mixture for final concentration determination.

Heparinized peripheral blood from CLL patients was separated on a Ficoll density gradient to obtain greater than 95% pure CLL B-cells. These cells are tested for expression of the CD5/CD19/CD23 antigens. Positive expression of these three antigens indicates that the cells are CLL B-cells (Pederson et al., Blood, 2002, 100, 2965, which is incorporated herein by reference in its entirety). Additionally, cytogenetic analysis can be performed to ascertain that the cells have the 13q deletion. A mixture of all four "natural" miRNA mimics at 2 μM each was electroporated into the cells. The cells were cultured in the presence or absence of apoptosis-inducing agents fludarabine A, or Dexamethasone (which are known to employ the intrinsic mitochondrial apoptotic pathway) or the antitumor agent CDDO-Im (reported to function through an alternative extrinsic apoptotic pathway) for 24 hours. Following incubation, apoptosis was monitored by annexin/PI double staining as outlined in FIG. 1 of Pederson et al., *Blood*, 2002, 100, 2965. The double-stranded RNA oligomeric compounds representing mir-15 and mir-16 miRNA mimics were observed to play a role in the induction of spontaneous as well as drug-induced apoptosis. Thus, oligomeric compounds of the present invention may be useful in the treatment of CD36-related diseases and conditions such as chronic lymphocytic leukemia and other cancers.

Example 23

Effect of Oligomeric Compounds Targeting miRNAs in vivo

As described herein, leptin-deficient (ob/ob) mice, leptin receptor-deficient (db/db) mice and diet-induced obesity (DIO) mice are used to model obesity and diabetes. In accordance with the present invention, oligomeric compounds targeting mir-143, mir-131 (also known as mir-9) and mir-203 were tested in the ob/ob and db/db models. The ob/ob mice were fed a high fat diet and were subcutaneously injected with the oligomeric compounds of the invention or a control compound at a dose of 25 mg/kg two times per week for 6 weeks. Saline-injected animals, leptin wildtype littermates (i.e. lean littermates) and ob/ob mice fed a standard rodent diet served as controls. The physiological effects resulting from inhibition of target RNA, such as the effects of target inhibition on glucose and insulin metabolism and the expression of genes that participate in lipid metabolism, cholesterol biosynthesis, fatty acid oxidation, fatty acid storage, gluconeogenesis and glucose metabolism, were assessed by methods disclosed herein. In brief, plasma levels of liver transaminases, cholesterol, triglycerides, free fatty acids and glucose were assessed weekly by tail bleed, with the tail bleed on week three taken under fasting conditions. After the treatment period, mice were sacrificed and liver, spleen, pancreas, muscle, kidney and heart, as well as brown adipose tissue (BAT) and white adipose tissue (WAT) tissues were collected. mRNA expression levels of the Glut4, aP2, HSL and PPARγ marker genes were evaluated. RNA isolation and target RNA expression level quantitation are performed as described.

Two oligomeric compounds targeting the mir-143 miRNA were compared for their effects on the physiological indications of obesity and diabetes. The oligomeric compound, ISIS Number 327901 (SEQ ID NO: 319), 22-nucleotides in length, targets the mature mir-143, and is a uniform 2'-MOE oligonucleotide with phosphorothioate internucleoside linkages throughout. The oligomeric compound ISIS Number 340927 (SEQ ID NO: 319) is a 5-10-7 gapmer also designed to target the mature mir-143 miRNA. The effects of these oligomeric compounds targeting mir-143 on several physiological parameters and markers of obesity and/or diabetes were examined in vivo. Potential effects on food consumption were also monitored.

Plasma cholesterol levels were observed to slightly decrease over time in ob/ob mice treated with the gapmer oligomeric compound ISIS Number 340927 (SEQ ID NO: 319) targeted to mir-143. Similarly, plasma triglyceride and plasma glucose levels were generally slightly lower in ob/ob mice treated with this compound as compared to untreated mice, or mice treated with control compounds. mRNA expression levels of the Glut4, aP2 and HSL marker genes were slightly reduced by both oligomeric compounds ISIS Number 327901 and ISIS Number 340927 targeting mir-143. Thus, these oligomeric compounds targeting mir-143 may be useful compounds in the treatment of obesity or diabetes.

In addition, Northern blot analyses were performed to quantitate the expression of mature mir-143 in kidney samples of ob/ob mice treated with oligomeric compounds of the present invention. The mir-143 specific DNA oligonucleotide probe (SEQ ID NO: 319) described above was used to detect expression levels of the mir-143 miRNA in ob/ob mice treated (twice weekly at 25 mg/kg) with ISIS Numbers 327901, the uniform 2'-MOE oligomeric compound, or ISIS Number 340927, the 5-10-7 gapmer compound, both targeted to mir-143, versus saline treated animals or animals treated with ISIS 342672 (SEQ ID NO: 789), a uniform 2'-MOE scrambled negative control oligomeric compound. Expression levels were normalized against the U6 RNA and the expression levels of saline treated animals were set at 100%. Most notably, in kidney samples from ob/ob mice treated with ISIS Number 327901, the uniform 2'-MOE oligomeric compound targeted to mir-143 exhibited a nearly 40% decrease in in vivo expression levels of the mature mir-143 miRNA. In kidney samples from mice treated with the gapmer oligomeric compound targeting mir-143, ISIS Number 340927, a 23% reduction in in vivo expression levels of the mature mir-143 miRNA was observed.

Oligomeric compounds targeting the mir-131/mir-9 and the mir-203 miRNAs were also tested for their effects on the physiological indicators or markers of obesity and diabetes. The oligomeric compound, ISIS Number 327892 (SEQ ID NO: 310), targeted to mir-131/mir-9, 21-nucleotides in length, is a uniform 2'-MOE oligonucleotide with phosphorothioate internucleoside linkages throughout. The oligomeric compound ISIS Number 340926 (SEQ ID NO: 310) is a 5-10-6 gapmer oligomeric compound also designed to target the mir-131/mir-9 miRNA. The oligomeric compound ISIS Number 327878 (SEQ ID NO: 296) targeted to mir-203, 22-nucleotides in length, is a uniform 2'-MOE oligonucleotide with phosphorothioate internucleoside linkages throughout. The oligomeric compound ISIS Number 345349 (SEQ ID NO: 296) is a 5-10-7 gapmer oligomeric compound also designed to target the mir-203 miRNA. The effects of these oligomeric compounds were examined in vivo in the ob/ob model. Potential effects on food consumption were also monitored.

Fed plasma glucose levels in ob/ob mice treated with the oligomeric compounds ISIS Number 327892 (SEQ ID NO: 310) and ISIS Number 340926 (SEQ ID NO: 310) targeted to mir-131/mir-9, and ISIS Number 327878 (SEQ ID NO: 296) and ISIS Number 345349 (SEQ ID NO: 296) targeted to mir-203 were observed to be reduced beginning at approximately four weeks after the start of treatment and continuing to decrease on week five as compared to untreated mice, or mice treated with control compounds. Triglyceride levels were also observed to be reduced over time in mice treated with ISIS 340926 and 345349, the gapmer oligomeric compounds targeted to mir-131/mir-9 and mir-203, respectively. No signs of liver toxicity were indicated by weekly measurements of plasma transaminases upon treatment of ob/ob mice with any of the oligomeric compounds targeting mir-143, mir-203 or mir-131/mir9.

ob/ob mice in the fasted state on day 19 after treatment with the oligomeric compounds ISIS Number 327892 (SEQ ID NO: 310) and ISIS Number 340926 (SEQ ID NO: 310) targeted to mir-131/mir-9 also exhibited significant reductions in plasma glucose levels. Notably, the gapmer oligomeric compound ISIS Number 340926 (SEQ ID NO: 310) targeted to mir-131/mir-9 was even more potent than the corresponding uniform 2'-MOE oligonucleotide ISIS Number 327892 (SEQ ID NO: 310).

Furthermore, a decrease in food consumption was observed by the third week and this reduced level was maintained in the fourth week post-treatment of ob/ob mice with these oligomeric compounds. Therefore, the oligomeric compounds targeting the mir-131/mir-9 and mir-203 miRNAs have potential use as appetite suppressants, as well as in the treatment of obesity or diabetes.

The oligomeric compounds ISIS Number 327901 and ISIS Number 340927 both targeting mir-143, ISIS Number 327892 and ISIS Number 340926 both targeting mir-131/mir-9, and ISIS Number 327878 and ISIS Number 345349 both targeting mir-203 were also tested in db/db mice. Although treatment of db/db mice with the gapmer compounds targeting mir-143, mir-203 or mir-131/mir9 resulted in an approximately 2-fold increase in liver transaminases in db/db mice, the uniform 2'-MOE oligomeric compounds targeting mir-143, mir-203 or mir-131/mir-9 were not found to cause liver toxicity in db/db mice, as assessed by weekly measurements of plasma transaminase levels.

Additional oligomeric compounds targeting miRNAs were studied in ob/ob mice. Six week old ob/ob mice were treated (dose=25 mg/kg, twice weekly for four weeks) with uniform 2'-MOE and gapmer oligomeric compounds targeting mir-143, mir-23b, mir-221, let-7a, and mir-29b, and compared to saline treated animals or animals treated with ISIS 342672 (SEQ ID NO: 789), a uniform 2'-MOE scrambled negative control oligomeric compound bearing 13 base mismatches to mir-143. Expression levels were normalized against the U6 RNA and the expression levels of saline treated animals were set at 100%. Fed plasma samples were taken bi-weekly by tail bleed, and plasma levels of liver transaminases, cholesterol, triglycerides, free fatty acids and glucose were assessed, with the tail bleed on week three taken under fasting conditions. Ob/ob mice were treated with ISIS Numbers 327901 and 340927, the uniform 2'-MOE and gapmer oligomeric compounds, respectively, targeting mir-143 are described above. Additionally, ob/ob mice were also treated with the following compounds: ISIS Number 327889 (SEQ ID NO: 307), a phosphorothioate uniform 2'-MOE oligomeric compound, and ISIS Number 340925 (SEQ ID NO: 307), a 2'-MOE 5-10-8 gapmer oligomeric compound, each targeting mir-23b; ISIS Number 327919 (SEQ ID NO: 337), a uniform 2'-MOE oligomeric compound, and ISIS Number 345384 (SEQ ID NO: 337), a phosphorothioate 2'-MOE 5-10-8 gapmer oligomeric compound, each targeting mir-221; ISIS Number 327903 (SEQ ID NO: 321), a uniform 2'-MOE oligomeric compound, and ISIS Number 345370 (SEQ ID NO: 321), a phosphorothioate 2'-MOE 5-10-7 gapmer oligomeric compound, each targeting let-7a; and ISIS Number 327876 (SEQ ID NO: 294), a uniform 2'-MOE oligomeric compound, and ISIS Number 345347 (SEQ ID NO: 294), a phosphorothioate 2'-MOE 5-10-8 gapmer oligomeric compound, each targeted to mir-29b-1.

Ob/ob mice treated with the gapmer compounds ISIS 340925 and ISIS 345384, targeting mir-23b and mir-221, respectively, exhibited reductions in plasma glucose levels in the fed state at weeks two and four, as compared to untreated mice, or mice treated with control compounds. Furthermore, mice treated with ISIS 340925 exhibited a decrease in triglycerides in the fourth week. Ob/ob mice treated with ISIS 340925 did not exhibit an increase in plasma transaminases at weeks two or four. Thus, the oligomeric compounds ISIS Numbers 340925 and 345384 may be useful as agents for the treatment of obesity and/or diabetes.

In addition, Northern blot analyses were performed to quantitate the expression of mir-23b in kidney samples of ob/ob mice treated with oligomeric compounds of the present invention. To detect the mir-23b target, a target-specific DNA oligonucleotide probe with the sequence GTGGTAATCCCTGGCAATGTGAT (SEQ ID NO: 307) was synthesized by IDT (Coralville, Iowa). The oligo probes were 5' end-labeled with T4 polynucleotide kinase with ($\gamma$-$^{32}$P) ATP (Promega). The mir-23b specific DNA oligonucleotide probe was used to detect expression levels of the mir-23b miRNA in ob/ob mice treated (twice weekly at 25 mg/kg) with ISIS Numbers 327889, the uniform 2'-MOE oligomeric compound, or ISIS Number 340925, the 5-10-8 gapmer compound, both targeted to mir-23b, versus saline treated animals or animals treated with a control oligomeric compound, ISIS Number 116847 (CTGCTAGCCTCTGGATTTGA; SEQ ID NO: 844), a uniform 5-10-5 2'-MOE gapmer targeting an unrelated gene, PTEN. Expression levels were normalized against the U6 RNA and the expression levels of saline treated animals were set at 100%. Most notably, in kidney samples from ob/ob mice treated with ISIS Number 327889, the uniform 2'-MOE oligomeric compound targeted to mir-23b exhibited a nearly 64% decrease in in vivo expression levels of the mir-23b miRNA. In kidney samples from mice treated with the gapmer oligomeric compound targeting mir-23b, ISIS Number 340925, a 41% reduction in in vivo expression levels of the mir-23b miRNA was observed.

As described, supra, the C57BL/6 mouse strain is reported to be susceptible to hyperlipidemia-induced atherosclerotic plaque formation, and when these mice are fed a high-fat diet, they develop diet-induced obesity (DIO). Accordingly, the DIO mouse model is useful for the investigation of obesity and development of agents designed to treat these conditions. In one embodiment of the present invention, oligomeric compounds targeting miRNAs were tested in the DIO model. Normal C57/BL6 male mice were fed a high fat diet (40% fat, 41% carbohydrate, 18% protein) for 12 weeks before the study began. DIO mice were then randomized by weight and insulin values. Initial body fat composition was determined by Dual X-ray Absorptiometry (DEXA) Scan. DIO mice were then subcutaneously injected with oligomeric compounds of the invention at a dose of 25 mg/kg, twice weekly. DIO mice were treated with oligomeric compounds ISIS Numbers 327901 and 340927 targeting mir-143, ISIS Numbers 327892 and 340926 targeting mir-131/mir-9, ISIS Numbers 327878 and ISIS Number 345349 targeting mir-203, and ISIS Numbers 327889 and 340925, targeting mir-23b. As negative controls, "scrambled" oligomeric compounds were also designed: ISIS Number 342672 contains 13 mismatches with respect to the mature mir-143 miRNA; ISIS Number 353607 (ACTAGTTTTTCTTACGTCTGA; herein incorporated as SEQ ID NO: 845) is a phosphorothioate 5-10-6 2'-MOE gapmer oligomeric compound containing 12 mismatches with respect to mir-131/mir-9; ISIS Number 353608 (CTAGACATTAGCTTTGACATCC; herein incorporated as SEQ ID NO: 846) is a phosphorothioate 5-10-7 2'-MOE gapmer oligomeric compound containing 16 mismatches with respect to mir-203. DEXA scans were also performed at weeks 0, 3 and 5 after treatment with the oligomeric compounds to assess the fat mass to lean mass ratio. The effects of target inhibition on levels of plasma glucose and insulin, liver transaminases, cholesterol and triglycerides, were also assessed weekly by tail bleed, and after the treatment period, mice were sacrificed and liver and kidney heart, as well as white adipose tissue (WAT) tissues collected. The mRNA expression levels of the Glut4, aP2, HSL and PPAR$\gamma$ marker genes are also assessed. Treatment of DIO mice with the uniform 2'-MOE oligomeric compounds ISIS 327901 targeting mir-143, ISIS 327892 targeting mir-131/mir9, ISIS 327878 targeting mir-203, and ISIS 327889 targeting mir-23b did not appear to cause liver toxicity in these mice as assessed by weekly measurements of plasma transaminase levels. Similarly, the gapmer oligomeric compounds ISIS 340927 targeting mir-143, and ISIS 340926 targeting mir-13 1/mir-9, 340925 did not cause significant increases in liver toxicity, and the gapmer compound ISIS 340925 targeting mir-23b caused only an approximately 2-fold increase in the liver transaminase AST. Interestingly, the gapmer compounds ISIS Numbers 340927 targeting mir-143, 340926 targeting mir-131/mir-9, 345349 targeting mir-203, and 340925, targeting mir-23b were all effective at reducing insulin levels at the two and four week time points, as compared to saline-treated control mice. Furthermore, some improvement in body composition (a reduction in body weight and fat mass) was observed. These data from the DIO model suggest that oligomeric compounds targeting mir-143, mir-131/mir-9, mir-203 and mir-23b may be useful as agents for the treatment of obesity and/or diabetes.

Having the information disclosed herein, one of ordinary skill in the art would comprehend that of other classes of inhibitors targeting mir-143, mir-209, mir-131/mir-9 and mir-23b miRNAs, such as antibodies, small molecules, and inhibitory peptides, can be assessed for their effects on the physiological indicators of diseases in in vivo models, and these inhibitors can be developed for the treatment, amelioration or improvement of physiological conditions associated Example 24

Effects of Oligomeric Compounds on Cell Cycling

Cell Cycle Assay:
Cell cycle regulation is the basis for various cancer therapeutics. Cell cycle checkpoints are responsible for surveillance of proper completion of certain steps in cell division such as chromosome replication, spindle microtubule attachment and chromosome segregation, and it is believed that checkpoint functions are compromised in some cancerous cells. Furthermore, because the shift from quiescence to an actively growing state as well as the passage through mitotic checkpoints are essential transitions in cancer cells, most current chemotherapy agents target dividing cells. For example, by blocking the synthesis of new DNA required for cell division, an anticancer drug can block cells in S-phase of the cell cycle. These chemotherapy agents impact many healthy organs as well as tumors. In some cases, a cell cycle regulator will cause apoptosis in cancer cells, but allow normal cells to undergo growth arrest and therefore remain unaffected. Loss of tumor supressors such as p53 sensitizes cells to certain anticancer drugs; however, cancer cells often escape apoptosis. Further disruption of cell cycle checkpoints in cancer cells can increase sensitivity to chemotherapy while allowing normal cells to take refuge in G1 and remain unaffected. A goal of these assays is to determine the effects of oligomeric compounds on the distribution of cells in various phases of the cell cycle.

In some embodiments, the effects of several oligomeric compounds of the present invention were examined in the normal human foreskin fibroblast BJ cell line, the mouse melanoma cell line B16-F10 (also known as B16 cells), as well as the breast carcinoma cell line, T47D. These cell lines can be obtained from the American Type Culture Collection (Manassas, Va.). BJ cells were routinely cultured in MEM high glucose with 2 mM L-glutamine and Earle's BSS adjusted to contain 1.5 g/L sodium bicarbonate and supplemented with 10 % fetal bovine serum, 0.1 mM non-essential amino acids and 1.0 mM sodium pyruvate (all media and supplements from Invitrogen Life Technologies, Carlsbad, Calif.). B16-F10 cells were routinely cultured in DMEM high glucose (Invitrogen Life Technologies, Carlsbad, Calif.) supplemented with 10% fetal bovine serum (Invitrogen Life Technologies, Carlsbad, Calif.). T47D cells were cultured in DMEM High glucose media (Invitrogen Life Technologies, Carlsbad, Calif.) supplemented with 10% fetal bovine serum. Cells were routinely passaged by trypsinization and dilution when they reached 80 to 90% confluence. Cells were plated on collagen-coated 24-well plates (Falcon-Primaria #3047, BD Biosciences, Bedford, Mass.) at approximately 50,000 cells per well and allowed to attach to wells overnight.

As a negative control, a random-mer oligomeric compound, 20 nucleotides in length, ISIS 29848 (SEQ ID NO: 737) was used. In addition, a positive control, ISIS 183891 (CCGAGCTCTCTTATCAACAG; herein incorporated as SEQ ID NO: 847) was included; ISIS 183891 targets kinesin-like 1 (also known as Eg5) and inhibits cell cycle progression. Eg5 is known to induce apoptosis when inhibited. ISIS 29248 and ISIS 183891 are chimeric oligomeric compounds ("gapmers") 20 nucleotides in length, composed of a central "gap" region consisting of ten 2'-deoxynucleotides, which is flanked on both sides (5' and 3' directions) by five-nucleotide "wings" (a "5-10-5 gapmer"). The wings are composed of 2'-methoxyethoxy (2'-MOE) nucleotides. The internucleoside (backbone) linkages are phosphorothioate (P=S) throughout the compound. All cytidine residues are 5-methylcytidines. ISIS 340348 (CTACCTGCACGAACAG-CACTTT; herein incorporated as SEQ ID NO: 848) is a uniform 2'-MOE phosphorothioate oligomeric compound targeting the mir-93 miRNA, and ISIS 340365 (TACTT-TATATAGAACACAAG; herein incorporated as SEQ ID NO: 849) is a 5-10-5 gapmer phosphorothioate oligomeric compound targeting the mir-92-2 miRNA.

Oligomeric compounds were mixed with LIPOFECTIN™ (Invitrogen Life Technologies, Carlsbad, Calif.) in OPTI-MEM™ (Invitrogen Life Technologies, Carlsbad, Calif.) to achieve a final concentration of 150 nM of oligomeric compound and 4.5 µg/ml LIPOFECTIN™. Before adding to cells, the oligomeric compound, LIPOFECTIN™ and OPTI-MEM™ were mixed thoroughly and incubated for 0.5 hrs. The medium was removed from the plates and each well was washed in 250 µl of phosphate-buffered saline. The wash buffer in each well was replaced with 250 µL of the oligomeric compound/OPTI-MEM™ /LIPOFECTIN cocktail. Control cells received LIPOFECTIN™ only. The plates were incubated for 4 hours at 37° C., after which the medium was removed. 100 µl of full growth medium was added to each well. After 72 hours, routine procedures were used to prepare cells for flow cytometry analysis and cells were fixed with ethanol and stained with propidium iodide to generate a cell cycle profile using a flow cytometer. The cell cycle profile was analyzed with the ModFit program (Verity Software House, Inc., Topsham Me.).

Fragmentation of nuclear DNA is a hallmark of apoptosis and produces an increase in cells with a hypodiploid DNA content. Cells with a hypodiploid DNA content are categorized as "subG1." The cells in the G1, G2M and S phases are considered to be cycling, and cells in the subG1 and aneuploid categories are considered to have left the cell cycle. An increase in cells in G1 phase is indicative of a cell cycle arrest prior to entry into S phase; an increase in cells in S phase is indicative of cell cycle arrest during DNA synthesis; and an increase in cells in the G2/M phase is indicative of cell cycle arrest just prior to or during mitosis. Data are shown in Table 29 and expressed as percentage of cells in each phase of the cell cycle.

TABLE 29

Effects of oligomeric compounds targeting miRNAs on cell cycling

| ISIS # | SEQ ID # | Pri-miRNA | SubG1 | G1 | S | G2/M | aneuploid |
|---|---|---|---|---|---|---|---|
| UTC | N/A | N/A | 8.1 | 59.6 | 27.5 | 12.9 | 7.3 |
| ISIS-29848 n-mer | 737 | N/A | 9.6 | 57.8 | 26.5 | 15.6 | 12 |
| ISIS-183891 Positive control | 847 | Kinesin-like 1/Eg5 | 20.8 | 33.1 | 39.2 | 27.6 | 11.5 |
| 327878 | 296 | mir-203 | 17.3 | 39.1 | 40.8 | 20 | 11.9 |
| 327888 | 306 | mir-108-1 | 13.3 | 53.7 | 29.5 | 16.7 | 12.9 |
| 327889 | 307 | mir-23b | 8.2 | 53.1 | 32.5 | 14.4 | 10.5 |
| 327901 | 319 | mir-143 | 12 | 34.7 | 44.9 | 20.3 | 13.6 |
| 327902 | 320 | mir-192-1 | 10.6 | 50.7 | 33.9 | 15.3 | 13.4 |
| 327903 | 321 | let-7a-3 | 11 | 53.7 | 30.9 | 15.4 | 13.4 |
| 327904 | 322 | mir-181a | 8.6 | 54.4 | 29.5 | 16.2 | 15.6 |
| 327905 | 323 | mir-205 | 8.5 | 56.9 | 28.1 | 15 | 14.7 |
| 327906 | 324 | mir-103-1 | 15.2 | 46.1 | 33 | 20.9 | 15.8 |
| 327907 | 325 | mir-26a | 17.8 | 49.5 | 32.8 | 17.6 | 17.8 |
| 327908 | 326 | mir-33a | 5.6 | 55.4 | 29.2 | 15.3 | 13.1 |

TABLE 29-continued

Effects of oligomeric compounds targeting miRNAs on cell cycling

| ISIS # | SEQ ID # | Pri-miRNA | SubG1 | G1 | S | G2/M | aneuploid |
|---|---|---|---|---|---|---|---|
| 327909 | 327 | mir-196-2 | 7.9 | 52.6 | 30.1 | 17.3 | 16.3 |
| 327910 | 328 | mir-107 | 9.3 | 49.5 | 33 | 17.5 | 13.1 |
| 327911 | 329 | mir-106 | 10.9 | 49.9 | 30.1 | 20 | 16.5 |
| 327914 | 332 | mir-130a | 8.5 | 55.8 | 28.9 | 15.3 | 16.2 |
| 327919 | 337 | mir-221 | 10.8 | 54.3 | 30.3 | 15.4 | 16 |
| 327922 | 340 | mir-19b-2 | 10 | 50.4 | 30.7 | 18.9 | 16.8 |
| 327928 | 346 | mir-29a-1 | 6.6 | 56 | 27.9 | 16 | 15.9 |
| 327933 | 351 | mir-145 | 10.2 | 49.6 | 31.3 | 19.1 | 15.9 |
| 327934 | 352 | mir-213 | 6.6 | 54.4 | 28.2 | 17.4 | 17 |
| 327941 | 359 | mir-181b | 8.2 | 57.2 | 29.9 | 12.9 | 15.8 |
| 327951 | 369 | mir-15a-1 | 4.3 | 60.9 | 24.8 | 14.3 | 16.7 |
| 328342 | 451 | mir-203 | 4.8 | 62.3 | 24.9 | 12.8 | 15.2 |
| 328362 | 471 | mir-108-1 | 9.1 | 51.2 | 33.6 | 15.1 | 12.9 |
| 328364 | 473 | mir-23b | 1.9 | 61.5 | 24.2 | 14.3 | 15.1 |
| 328382 | 491 | mir-143 | 2.9 | 59.8 | 25.7 | 14.4 | 14.8 |
| 328388 | 497 | let-7a-3 | 4.0 | 57.5 | 28 | 14.6 | 14.5 |
| 328394 | 503 | mir-181a | 2.4 | 59.5 | 24.5 | 16 | 18.3 |
| 328396 | 505 | mir-205 | 4.6 | 56.8 | 28.2 | 15 | 19.8 |
| 328419 | 528 | mir-221 | 6.0 | 51.2 | 32.5 | 16.3 | 17.9 |
| 328423 | 532 | mir-19b-2 | 4.9 | 52.9 | 32.4 | 14.8 | 15.3 |
| 328424 | 533 | mir-19b-2 | 3.1 | 61.9 | 23.7 | 14.4 | 16.9 |
| 328436 | 545 | mir-29a-1 | 3.5 | 59.2 | 26.9 | 13.9 | 17.4 |
| 328644 | 553 | mir-145 | 7.2 | 58.4 | 27.6 | 14 | 17.5 |
| 328691 | 600 | mir-145 | 7.7 | 60.5 | 24.4 | 15.1 | 16.6 |
| 328697 | 606 | mir-181b | 2.4 | 57.6 | 26.4 | 16 | 13.5 |
| 328773 | 682 | mir-15a-2 | 2.7 | 56.4 | 26.9 | 16.7 | 11.7 |
| 340348 | 848 | mir-93 | 14.1 | 53.9 | 31.8 | 14.3 | 12.3 |
| 340365 | 849 | mir-92-2 | 4.3 | 55.2 | 29.4 | 15.4 | 18.3 |

From these data, it is evident that treatment with the oligomeric compounds targeting mir-143, ISIS Number 327901 (SEQ ID NO: 319); mir-203, ISIS Number 327878 (SEQ ID NO: 296); mir-103-1, ISIS Number 327906 (SEQ ID NO: 324); mir-106, ISIS Number 327911 (SEQ ID NO: 329); and mir-145, ISIS Number 327933 (SEQ ID NO: 351) resulted in an increased percentage of cells in the G2/M phase, indicating that these oligomeric compounds arrest or delay the cell cycle at or just prior to mitosis, potentially activating a mitotic checkpoint.

Treatment with the oligomeric compounds targeting mir-26a, ISIS Number 327907 (SEQ ID NO: 325); mir-205, ISIS Number 328396 (SEQ ID NO: 505); mir-181a, ISIS Number 328394 (SEQ ID NO: 503); and mir-92-2, ISIS Number 340365 (SEQ ID NO: 849) resulted in higher than average percentages of aneuploid cells, indicating that these oligomeric compounds interfere with proper chromosome segregation.

Treatment with the oligomeric compounds targeting mir-203, ISIS Number 327878 (SEQ ID NO: 296); mir-103-1, ISIS Number 327906 (SEQ ID NO: 324); mir-26a, ISIS Number 327907 (SEQ ID NO: 325); and mir-93, ISIS Number 340348 (SEQ ID NO: 848) resulted in an increased percentage of cells with hypodiploid DNA content (SubG1 phase) indicating that the oligomeric compound treatment may induce apoptotic events.

The effects of several oligomeric compounds of the present invention were also examined in the HeLa and A549 human carcinoma cell lines, both of which can be obtained from the American Type Culture Collection (Manassas, Va.).

In some embodiments, HeLa cells were plated on collagen-coated 24-well plates at 50,000-60,000 cells per well, and allowed to attach to wells overnight. In some embodiments, HeLa cells were synchronized by double thymidine block (cells were washed three times with PBS, then grown in 10% FBS containing 2 mM thymidine; then 19 hours later, cells were washed three times in PBS, 10% FBS for 9 hours; cells were then incubated in 10% FBS, 2 mM thymidine for 15 hours; then washed three times with PBS, 10% FBS and samples were taken every two hours over a 16 hour period). A portion of each time sample was fixed with ethanol and treated with propidium iodide and subjected to FACs analysis for determination of the percentage of cells in each phase of the cell cycle. Distinctive peaks were observed for G0-, S—, Early G2/M-, Late G2/M-, and G1-phases of the cell cycle at 0-, 4-, 6-, 8-, and 12 hours, respectively, indicating that the cells were synchronized. HeLa cells treated with 10 μM cisplatin or 100 ng/ml nocodazole were used as controls for G1-phase and late G2/M-phases, respectively. From the remaining portion of each of these time samples, total RNA was isolated and used to assess the expression of cell cycle marker mRNAs using the real-time RT-PCR methods and/or used to screen microarrays to assess the expression of miRNAs over the course of the cell cycle. It was observed that several miRNAs are expressed in a cell-cycle-dependent manner. Shown in Table 30 are the mRNA levels of the E2F1 transcription factor and topoisomerase 2A (Top2A), which vary over the course of the cell cycle and can be used for comparison to the experimental groups for the confirmation of cell cycle phase. Data are an average of three trials.

TABLE 30

Expression levels of cell cycle markers

| treatment | E2F1 mRNA | Top2A mRNA |
|---|---|---|
| 10 uM cisplatin | 102 | 15 |
| 100 ng/ml nocodazole | 23 | 176 |
| 0 hrs (G0-phase) | 100 | 100 |
| 4 hrs (S-phase) | 81 | 105 |
| 6 hrs (early G2/M-phase) | 39 | 221 |
| 8 hrs (late G2/M-phase) | 50 | 254 |
| 12 hrs (G1-phase) | 61 | 124 |

In some embodiments, HeLa cells were also treated with oligomeric compounds targeting miRNAs. As described above, oligomeric compounds were mixed with LIPOFECTIN™ in OPTI-MEM™ (Invitrogen Life Technologies, Carlsbad, Calif.) to a final concentration of 150 nM of oligomeric compound and 6 μg/ml LIPOFECTIN™. Before adding to cells, the oligomeric compound, LIPOFECTIN™ and OPTI-MEM™ were mixed thoroughly and incubated for 0.5 hrs. The medium was removed from the plates. Each well was washed in 250 μl of PBS. The wash buffer in each well was replaced with 250 μL of the oligomeric compound/OPTI-MEM™/LIPOFECTIN cocktail. Control cells received LIPOFECTIN™ only. The plates were incubated for 4 hours at 37° C., after which the medium was removed. 1000 μl of full growth medium was added to each well. After 24 hours (Table 31) or 48 hours (Table 32), cells were prepared for flow cytometry analysis to generate a cell cycle profile. The cell cycle profile was analyzed with the ModFit program (Verity Software House, Inc., Topsham Me.).

The random-mer ISIS 29848 (SEQ ID NO: 737) was used as a negative control, and ISIS 183891 (SEQ ID NO: 847), targeting kinesin-like 1/Eg5, was included as a positive control. Results of these experiments are shown in Tables 31 and 32. Data are expressed as percentage of cells in each phase relative to the untreated control (UTC); values above 100 are considered to indicate a delay or arrest in that phase of the cell cycle. Table 31 shows the results from cells sampled 24 hours after oligomeric compound treatment, and Table 32 shows the results from cells sampled 48 hours after oligomeric compound treatment. In some cases, the same oligomeric compound was tested in repeated experiments.

TABLE 31

Effects of oligomeric compounds targeting miRNAs on cell cycling (24 hours)

| Pri-miRNA | ISIS # | SEQ ID # | subG1 | G1 | S | G2/M | aneuploid |
|---|---|---|---|---|---|---|---|
| UTC | N/A | N/A | 100 | 100 | 100 | 100 | 100 |
| n-mer | 29848 | 737 | 120 | 116 | 81 | 108 | 76 |
| Kinesin-like 1/Eg5 | 183891 | 847 | 251 | 21 | 109 | 231 | 95 |
| collagen, type I, alpha 1/ hypothetical miRNA-144 | 338797 | 624 | 197 | 101 | 79 | 148 | 193 |
| hypothetical miRNA-039 | 338666 | 493 | 235 | 123 | 63 | 158 | 102 |
| hypothetical miRNA-111 | 328111 | 413 | 62 | 127 | 75 | 99 | 50 |
| hypothetical miRNA-111 | 338750 | 577 | 107 | 148 | 76 | 97 | 166 |
| hypothetical miRNA-142 | 328115 | 417 | 177 | 90 | 87 | 147 | 59 |
| hypothetical miRNA-154 | 328119 | 421 | 75 | 100 | 94 | 112 | 83 |
| hypothetical miRNA-154 | 328724 | 633 | 155 | 91 | 90 | 135 | 197 |
| hypothetical miRNA-179 | 328749 | 658 | 312 | 126 | 82 | 110 | 138 |
| hypothetical miRNA-179 | 328780 | 689 | 124 | 96 | 87 | 136 | 149 |
| hypothetical miRNA-181 | 328136 | 438 | 330 | 125 | 81 | 88 | 51 |
| hypothetical miRNA-181 | 338833 | 660 | 232 | 150 | 56 | 142 | 185 |
| let-7a-3 | 327903 | 321 | 118 | 92 | 104 | 106 | 98 |
| let-7a-3 | 328388 | 375 | 120 | 110 | 83 | 115 | 85 |
| mir-100-1 | 327957 | 497 | 197 | 91 | 88 | 145 | 66 |
| mir-100-1 | 328707 | 616 | 188 | 36 | 93 | 195 | 166 |
| mir-103-1 | 327906 | 324 | 228 | 153 | 47 | 107 | 65 |
| mir-103-1 | 328397 | 506 | 134 | 93 | 86 | 142 | 91 |
| mir-106 | 327911 | 329 | 158 | 130 | 62 | 122 | 104 |
| mir-106 | 328403 | 512 | 284 | 70 | 85 | 197 | 53 |
| mir-106 | 328403 | 512 | 189 | 86 | 75 | 179 | 82 |
| mir-107 | 327910 | 328 | 174 | 154 | 42 | 118 | 73 |
| mir-108-1 | 328362 | 471 | 114 | 101 | 87 | 126 | 66 |
| mir-10a | 327949 | 367 | 194 | 82 | 84 | 172 | 68 |
| MiR-125a, Mouse | 341787 | 852 | 221 | 113 | 75 | 144 | 165 |
| mir-127, Mouse | 341788 | 853 | 303 | 154 | 54 | 140 | 114 |
| mir-130b | 328687 | 596 | 231 | 80 | 98 | 131 | 149 |
| mir-130b | 338769 | 596 | 188 | 171 | 61 | 103 | 133 |
| mir-131-2/mir-9 | 327892 | 310 | 153 | 86 | 111 | 103 | 80 |
| mir-131-2/mir-9 | 328369 | 310 | 84 | 100 | 88 | 125 | 71 |
| mir-131-2/mir-9 | 340926 | 478 | 286 | 98 | 91 | 121 | 83 |
| mir-133b | 338713 | 540 | 93 | 152 | 72 | 101 | 187 |
| mir-141 | 338741 | 568 | 157 | 141 | 73 | 112 | 166 |
| mir-143 | 327901 | 319 | 108 | 101 | 94 | 110 | 90 |
| mir-143 | 328382 | 491 | 81 | 118 | 76 | 116 | 78 |
| mir-143 | 328382 | 491 | 226 | 102 | 80 | 144 | 202 |
| mir-143 | 340927 | 319 | 118 | 121 | 75 | 111 | 88 |
| mir-143 | 340927 | 319 | 131 | 128 | 71 | 106 | 87 |
| mir-145 | 327933 | 351 | 192 | 102 | 83 | 131 | 92 |
| mir-145 | 327933 | 351 | 190 | 90 | 91 | 140 | 47 |
| mir-145 | 328644 | 553 | 71 | 113 | 84 | 109 | 68 |
| mir-145 | 345395 | 351 | 247 | 54 | 82 | 222 | 77 |
| mir-149, Mouse | 341785 | 854 | 125 | 152 | 92 | 53 | 158 |
| mir-152 | 328727 | 636 | 245 | 133 | 81 | 105 | 161 |
| mir-152 | 338809 | 636 | 106 | 159 | 82 | 69 | 210 |

TABLE 31-continued

Effects of oligomeric compounds targeting miRNAs on cell cycling (24 hours)

| Pri-miRNA | ISIS # | SEQ ID # | subG1 | G1 | S | G2/M | aneuploid |
|---|---|---|---|---|---|---|---|
| mir-16-3 | 327877 | 295 | 154 | 107 | 66 | 159 | 62 |
| mir-17/mir-91 | 327885 | 303 | 151 | 129 | 63 | 121 | 55 |
| mir-181a-1 | 327904 | 322 | 114 | 99 | 102 | 99 | 89 |
| mir-182 | 328744 | 653 | 229 | 31 | 108 | 167 | 111 |
| mir-182 | 338826 | 653 | 145 | 148 | 79 | 90 | 138 |
| mir-192-1 | 327902 | 320 | 178 | 57 | 106 | 176 | 66 |
| mir-192-1 | 327902 | 320 | 175 | 44 | 121 | 163 | 98 |
| mir-192-1 | 328383 | 492 | 314 | 55 | 82 | 222 | 92 |
| mir-192-1 | 328383 | 492 | 289 | 63 | 97 | 183 | 98 |
| mir-192-1 | 338665 | 340 | 173 | 85 | 76 | 175 | 193 |
| mir-19b-2 | 327922 | 492 | 131 | 97 | 96 | 114 | 104 |
| mir-19b-2 | 328424 | 533 | 60 | 110 | 85 | 112 | 74 |
| mir-203 | 327878 | 296 | 124 | 96 | 94 | 122 | 73 |
| mir-203 | 328342 | 451 | 192 | 33 | 95 | 238 | 67 |
| mir-205 | 327905 | 323 | 144 | 99 | 88 | 129 | 50 |
| mir-205 | 327905 | 323 | 149 | 94 | 95 | 121 | 98 |
| mir-205 | 328396 | 505 | 97 | 94 | 87 | 139 | 88 |
| mir-205 | 338678 | 505 | 162 | 122 | 75 | 131 | 202 |
| mir-211 | 327946 | 364 | 225 | 90 | 84 | 156 | 43 |
| mir-211 | 328674 | 583 | 564 | 125 | 93 | 84 | 69 |
| mir-211 | 338756 | 583 | 137 | 147 | 75 | 99 | 166 |
| mir-213/mir-181a-2 | 327934 | 352 | 278 | 87 | 85 | 160 | 55 |
| mir-213/mir-181a-2 | 327934 | 352 | 204 | 118 | 66 | 137 | 77 |
| mir-213/mir-181a-2 | 328647 | 556 | 140 | 101 | 92 | 119 | 140 |
| mir-216 | 327956 | 374 | 120 | 124 | 68 | 120 | 61 |
| mir-216 | 328759 | 668 | 239 | 88 | 78 | 168 | 184 |
| mir-22 | 327896 | 314 | 121 | 83 | 103 | 128 | 65 |
| mir-22 | 328374 | 483 | 198 | 54 | 115 | 162 | 97 |
| mir-220 | 327944 | 362 | 165 | 85 | 110 | 111 | 50 |
| mir-221 | 327919 | 337 | 85 | 92 | 103 | 109 | 96 |
| mir-221 | 328419 | 528 | 87 | 109 | 79 | 124 | 77 |
| mir-23a | 338836 | 663 | 153 | 185 | 53 | 105 | 150 |
| mir-23b | 327889 | 307 | 122 | 104 | 102 | 87 | 82 |
| mir-23b | 340925 | 307 | 151 | 103 | 89 | 117 | 73 |
| mir-26a-1 | 327907 | 325 | 224 | 119 | 77 | 111 | 75 |
| mir-26a-1 | 345373 | 325 | 196 | 66 | 94 | 176 | 68 |
| mir-29b-1 | 327876 | 294 | 103 | 98 | 104 | 95 | 66 |
| mir-29b-1 | 327876 | 294 | 149 | 93 | 92 | 131 | 75 |
| mir-29b-1 | 328337 | 446 | 107 | 106 | 88 | 113 | 104 |
| mir-29b-1 | 328337 | 446 | 99 | 108 | 88 | 109 | 64 |
| mir-29b-2 | 328339 | 448 | 235 | 77 | 102 | 143 | 61 |
| mir-29c | 338690 | 517 | 149 | 124 | 78 | 123 | 194 |
| mir-30a | 328084 | 585 | 381 | 43 | 104 | 163 | 101 |
| mir-30b | 328676 | 585 | 139 | 99 | 86 | 134 | 169 |
| mir-30b | 338758 | 743 | 113 | 129 | 81 | 108 | 190 |
| mir-30d | 328421 | 530 | 288 | 47 | 105 | 200 | 70 |
| mir-33a | 327908 | 326 | 138 | 98 | 99 | 106 | 114 |
| mir-92-1 | 327897 | 315 | 143 | 114 | 80 | 115 | 69 |
| mir-92-1 | 327897 | 315 | 180 | 128 | 74 | 100 | 54 |
| mir-92-2 | 340365 | 849 | 109 | 125 | 71 | 114 | 84 |
| mir-95 (Mourelatos) | 340350 | 855 | 218 | 183 | 54 | 104 | 94 |
| mir-96 | 338637 | 464 | 88 | 170 | 70 | 84 | 188 |

TABLE 32

Effects of oligomeric compounds targeting miRNAs on cell cycling (48 hours)

| Pri-miRNA | ISIS # | SEQ ID # | subG1 | G1 | S | G2/M | aneuploid |
|---|---|---|---|---|---|---|---|
| UTC | N/A | N/A | 100 | 100 | 100 | 100 | 100 |
| n-mer | 29848 | 737 | 86 | 87 | 121 | 117 | 109 |

TABLE 32-continued

Effects of oligomeric compounds targeting miRNAs on cell cycling (48 hours)

| Pri-miRNA | ISIS # | SEQ ID # | % cells in cell cycle phase ||||
|---|---|---|---|---|---|---|---|
| | | | subG1 | G1 | S | G2/M | aneuploid |
| Kinesin-like 1/Eg5 | 183891 | 847 | 173 | 19 | 124 | 331 | 72 |
| collagen, type I, alpha 1/hypothetical miRNA-144 | 338797 | 624 | 813 | 66 | 124 | 168 | 175 |
| hypothetical miRNA-039 | 338666 | 493 | 1832 | 44 | 136 | 217 | 125 |
| hypothetical miRNA-111 | 328111 | 413 | 371 | 84 | 126 | 119 | 90 |
| hypothetical miRNA-111 | 338750 | 577 | 201 | 99 | 101 | 103 | 190 |
| hypothetical miRNA-142 | 328115 | 417 | 195 | 92 | 114 | 107 | 86 |
| hypothetical miRNA-154 | 328119 | 421 | 767 | 75 | 145 | 124 | 81 |
| hypothetical miRNA-154 | 328724 | 633 | 653 | 70 | 134 | 140 | 155 |
| hypothetical miRNA-179 | 328749 | 658 | 962 | 37 | 129 | 246 | 65 |
| hypothetical miRNA-179 | 328780 | 689 | 917 | 83 | 130 | 110 | 133 |
| hypothetical miRNA-181 | 328136 | 438 | 140 | 83 | 133 | 113 | 85 |
| hypothetical miRNA-181 | 338833 | 660 | 1091 | 44 | 106 | 258 | 154 |
| let-7a-3 | 327903 | 321 | 74 | 102 | 95 | 98 | 94 |
| let-7a-3 | 328388 | 375 | 112 | 99 | 101 | 102 | 126 |
| mir-100-1 | 327957 | 497 | 864 | 65 | 169 | 127 | 85 |
| mir-100-1 | 328707 | 616 | 1486 | 46 | 134 | 213 | 155 |
| mir-103-1 | 327906 | 324 | 57 | 100 | 98 | 103 | 83 |
| mir-103-1 | 328397 | 506 | 74 | 97 | 101 | 109 | 96 |
| mir-106 | 327911 | 329 | 65 | 99 | 96 | 109 | 101 |
| mir-106 | 328403 | 512 | 863 | 61 | 177 | 131 | 85 |
| mir-106 | 328403 | 512 | 108 | 82 | 148 | 106 | 80 |
| mir-107 | 327910 | 328 | 53 | 99 | 91 | 111 | 92 |
| mir-108-1 | 328362 | 471 | 87 | 96 | 104 | 108 | 97 |
| mir-10a | 327949 | 367 | 773 | 66 | 157 | 138 | 71 |
| MiR-125a, Mouse | 341787 | 852 | 707 | 55 | 126 | 197 | 153 |
| mir-127, Mouse | 341788 | 853 | 748 | 76 | 105 | 163 | 116 |
| mir-130b | 328687 | 596 | 1119 | 55 | 174 | 131 | 171 |
| mir-130b | 338769 | 596 | 482 | 76 | 116 | 149 | 194 |
| mir-131-2/mir-9 | 327892 | 310 | 121 | 74 | 150 | 129 | 79 |
| mir-131-2/mir-9 | 328369 | 310 | 72 | 99 | 95 | 109 | 109 |
| mir-131-2/mir-9 | 340926 | 478 | 68 | 83 | 120 | 131 | 106 |
| mir-133b | 338713 | 540 | 426 | 95 | 104 | 109 | 194 |
| mir-141 | 338741 | 568 | 185 | 100 | 101 | 99 | 170 |
| mir-143 | 327901 | 319 | 93 | 98 | 104 | 103 | 104 |
| mir-143 | 328382 | 491 | 71 | 102 | 92 | 103 | 109 |
| mir-143 | 328382 | 491 | 350 | 83 | 122 | 120 | 133 |
| mir-143 | 340927 | 319 | 95 | 91 | 107 | 121 | 113 |
| mir-143 | 340927 | 319 | 83 | 91 | 107 | 122 | 108 |
| mir-145 | 327933 | 351 | 91 | 76 | 135 | 138 | 86 |
| mir-145 | 327933 | 351 | 438 | 80 | 133 | 123 | 75 |
| mir-145 | 328644 | 553 | 52 | 101 | 101 | 98 | 82 |
| mir-145 | 345395 | 351 | 213 | 51 | 192 | 157 | 87 |
| mir-149, Mouse | 341785 | 854 | 1148 | 82 | 126 | 116 | 166 |
| mir-152 | 328727 | 636 | 846 | 68 | 152 | 124 | 140 |
| mir-152 | 338809 | 636 | 345 | 86 | 110 | 129 | 157 |
| mir-16-3 | 327877 | 295 | 755 | 59 | 152 | 168 | 80 |
| mir-17/mir-91 | 327885 | 303 | 456 | 78 | 129 | 133 | 76 |
| mir-181a-1 | 327904 | 322 | 116 | 87 | 126 | 114 | 80 |
| mir-182 | 328744 | 653 | 1774 | 31 | 78 | 334 | 171 |
| mir-182 | 338826 | 653 | 696 | 61 | 124 | 182 | 137 |
| mir-192-1 | 327902 | 320 | 1176 | 39 | 171 | 208 | 81 |
| mir-192-1 | 327902 | 320 | 202 | 44 | 166 | 205 | 87 |
| mir-192-1 | 328383 | 492 | 303 | 53 | 217 | 124 | 90 |
| mir-192-1 | 328383 | 492 | 940 | 54 | 178 | 150 | 90 |
| mir-192-1 | 338665 | 340 | 1629 | 40 | 89 | 292 | 149 |
| mir-19b-2 | 327922 | 492 | 81 | 96 | 105 | 109 | 91 |
| mir-19b-2 | 328424 | 533 | 89 | 103 | 91 | 101 | 111 |
| mir-203 | 327878 | 296 | 50 | 89 | 119 | 114 | 92 |
| mir-203 | 328342 | 451 | 189 | 55 | 115 | 225 | 107 |
| mir-205 | 327905 | 323 | 719 | 48 | 194 | 150 | 67 |
| mir-205 | 327905 | 323 | 100 | 78 | 143 | 122 | 99 |
| mir-205 | 328396 | 505 | 88 | 89 | 114 | 119 | 129 |
| mir-205 | 338678 | 505 | 1158 | 81 | 78 | 188 | 179 |
| mir-211 | 327946 | 364 | 431 | 72 | 150 | 129 | 76 |
| mir-211 | 328674 | 583 | 1663 | 69 | 160 | 109 | 134 |
| mir-211 | 338756 | 583 | 311 | 90 | 121 | 100 | 169 |
| mir-213/mir-181a-2 | 327934 | 352 | 752 | 62 | 156 | 152 | 92 |
| mir-213/mir-181a-2 | 327934 | 352 | 155 | 66 | 148 | 155 | 117 |
| mir-213/mir-181a-2 | 328647 | 556 | 589 | 69 | 153 | 118 | 136 |
| mir-216 | 327956 | 374 | 184 | 91 | 106 | 121 | 110 |
| mir-216 | 328759 | 668 | 1744 | 50 | 31 | 343 | 148 |
| mir-22 | 327896 | 314 | 886 | 55 | 140 | 194 | 66 |
| mir-22 | 328374 | 483 | 787 | 65 | 157 | 143 | 71 |
| mir-220 | 327944 | 362 | 490 | 75 | 129 | 144 | 78 |
| mir-221 | 327919 | 337 | 104 | 80 | 122 | 139 | 104 |
| mir-221 | 328419 | 528 | 83 | 99 | 96 | 107 | 112 |
| mir-23a | 338836 | 663 | 811 | 52 | 152 | 169 | 165 |
| mir-23b | 327889 | 307 | 133 | 78 | 137 | 130 | 101 |
| mir-23b | 340925 | 307 | 89 | 87 | 130 | 109 | 93 |
| mir-26a-1 | 327907 | 325 | 116 | 92 | 111 | 115 | 94 |
| mir-26a-1 | 345373 | 325 | 116 | 75 | 132 | 145 | 119 |
| mir-29b-1 | 327876 | 294 | 41 | 87 | 120 | 119 | 100 |
| mir-29b-1 | 327876 | 294 | 251 | 76 | 141 | 126 | 69 |
| mir-29b-1 | 328337 | 446 | 66 | 92 | 105 | 119 | 108 |
| mir-29b-1 | 328337 | 446 | 662 | 73 | 143 | 135 | 74 |
| mir-29b-2 | 328339 | 448 | 678 | 73 | 153 | 123 | 92 |
| mir-29c | 338690 | 517 | 413 | 91 | 110 | 112 | 190 |
| mir-30a | 328084 | 585 | 1028 | 20 | 168 | 241 | 57 |
| mir-30b | 328676 | 585 | 366 | 86 | 118 | 118 | 172 |
| mir-30b | 338758 | 743 | 267 | 103 | 99 | 92 | 153 |
| mir-30d | 328421 | 530 | 1103 | 30 | 202 | 198 | 64 |
| mir-33a | 327908 | 326 | 61 | 99 | 98 | 105 | 93 |
| mir-92-1 | 327897 | 315 | 134 | 100 | 103 | 95 | 84 |
| mir-92-1 | 327897 | 315 | 125 | 94 | 114 | 105 | 63 |
| mir-92-2 | 340365 | 849 | 71 | 99 | 94 | 109 | 129 |
| mir-95 (Mourelatos) | 340350 | 855 | 1144 | 76 | 126 | 134 | 125 |
| mir-96 | 338637 | 464 | 239 | 90 | 109 | 117 | 210 |

Several oligomeric compounds were observed to result in an arrest or delay of the cell cycle, in some cases correlating with a cell-cycle-dependent expression profile as determined by miRNA microarray analysis.

For example, from these data, it was observed that treatment of HeLa cells with oligomeric compounds (MOE-gapmers and fully modified MOEs) targeting miRNAs caused an increase in the percentage of cells exhibiting a subG1-phase or aneuploid DNA content, indicating aberrant chromosome segregation. Treatment with oligomeric compounds ISIS Number 338797 (SEQ ID NO: 624) targeted to hypothetical miRNA-144, ISIS Number 338833 (SEQ ID NO: 660) targeted to hypothetical miRNA-181, and ISIS Number 328759 (SEQ ID NO: 668) targeted to mir-216, each appeared to cause an induce chromosome missegregation events at both the 24-hour and 48-hour timepoints. Thus, these compounds may be useful in triggering a checkpoint arrest in rapidly dividing cells, potentially useful in the treatment of hyperproliferative disorders such as cancer.

It was also observed that other oligomeric compounds (MOE-gapmers and fully modified MOEs) targeting miRNAs appeared to induce an arrest or delay in the G1-, S—, or G2/M-phases of the cell cycle. By miRNA microarray analysis, expression levels of the mir-205 miRNA were observed to increase in the S-and G1-phases of the cell cycle in HeLa cells. Treatment of HeLa cells with the oligomeric compound ISIS Number 327905 (SEQ ID NO: 323), targeting the mir-205 miRNA, was observed to arrest or delay the cell cycle in S-phase at the 48-hour time point, suggesting that the mir-205 miRNA may play a role in regulating DNA replication. It was also observed that treatment of HeLa cells with the oligomeric compound ISIS Number 338678 (SEQ ID NO: 505), targeted to the mir-205 pri-miRNA, resulted in an arrest or delay primarily in the G2/M-phase of the cell cycle, suggesting that this oligomeric compound may interfere with processing of the miRNA precursor into a mature miRNA, which appears to have an impact on mitosis.

Treatment of HeLa cells with oligomeric compounds ISIS Number 327892 (SEQ ID NO: 310), targeting mir-131/mir-9, and ISIS Number 327934 (SEQ ID NO: 352), targeting mir-213/mir-181 a-2, was observed to arrest or delay the cell cycle in G2/M-and S-phases at the 48-hour time point, suggesting that the mir-131/mir-9 and mir-213/mir-181 a-2 miRNAs are involved in regulating DNA replication and entry into mitosis.

Treatment of HeLa cells with oligomeric compound ISIS Number 345373 (SEQ ID NO: 325), targeting miR-26a-1, was observed to arrest or delay cells mainly in the G2/M-phase at 24 hrs after oligonucleotide-treatment, and at 48 hrs after oligonucleotide-treatment to arrest or delay cells mainly in S-phase of the cell cycle, suggesting that miR-26a-1 is involved in mitosis and that cells making it through a first round of cell division may harbor errors that cause them to arrest during a new round of DNA replication.

By miRNA microarray analysis, expression levels of the mir-145 miRNA were observed to increase in the G2/M-phase of the cell cycle in HeLa cells, and treatment of HeLa cells with the oligomeric compounds ISIS Number 327933 (SEQ ID NO: 351), a uniform 2'-MOE compound, and ISIS Number 345395 (SEQ ID NO: 351), a chimeric 2'-MOE gapmer compound, both targeting the mir-145 miRNA, were observed to arrest or delay the cell cycle in G2/M-phase at the 24-hour time point and at subG1-phase at the 48-hour time point, suggesting that the mir-145 miRNA plays a role in mitosis and that cells making it through a first round of cell division may harbor errors that cause them to arrest before a new round of DNA replication.

By miRNA microarray analysis, expression levels of the mir-192-1 miRNA were observed to increase in the G2/M-phase of the cell cycle in HeLa cells, and treatment of HeLa cells with the oligomeric compounds ISIS Number 327902 (SEQ ID NO: 320), a uniform 2'-MOE compound, and ISIS Number 328383 (SEQ ID NO: 492), a chimeric 2'-MOE gapmer compound, targeted against the mir-192-1 miRNA and the mir-192-1 precursor, respectively, were observed to arrest or delay the cell cycle in the G2/M-phase at 24-hours after oligonucleotide treatment, and at both the S— and G2/M-phases at the 48-hour time point, suggesting that the mir-192 miRNA is involved in mitosis, and that cells making it through a first round of cell division may harbor errors that cause them to arrest during a new round of DNA replication. A uniform 2'-MOE oligomeric compound ISIS Number 338665 targeting the mir-192-1 precursor was also observed to induce a G2/M-phase arrest at both time points.

Treatment of HeLa cells with the oligomeric compound ISIS Number 328744 (SEQ ID NO: 653), targeting the mir-182 miRNA, was observed to arrest or delay the cell cycle in G2/M-phase at 48-hours after oligonucleotide treatment, suggesting that the mir-182 miRNA plays a role in regulating mitosis.

Treatment of HeLa cells with the oligomeric compound ISIS Number 328421 (SEQ ID NO: 530), targeting miR-30d was also observed to arrest or delay cells mainly in the G2/M-phase at the 24-hour time point and at both the S— and G2/M-phases at the 48-hour time point after oligonucleotide treatment, suggesting that the mir-30d miRNA is involved in mitosis, and that a cell division error arising from the first round of division may allow cells to pass through mitosis and initiate a second round of division, but then a cell cycle checkpoint is set off before the cells are able to complete DNA synthesis.

Treatment of HeLa cells with the oligomeric compound ISIS Number 328403 (SEQ ID NO: 512), targeting mir-106 was also observed to arrest or delay cells in the G2/M-phase at the 24-hour time point and at both the S— and G2/M-phases at the 48-hour time point after oligonucleotide treatment, suggesting that the mir-106 miRNA is involved in mitosis, and that a cell division error arising from the first round of division may allow cells to pass through mitosis and initiate a second round of division, but then a cell cycle checkpoint is set off before the cells are able to complete DNA synthesis. Interestingly, the cell cycle regulatory transcription factor E2F 1 mRNA is reported to be a target of the mir-106 miRNA (Lewis et al., *Cell*, 2003, 115, 787-798).

Treatment of HeLa cells with the oligomeric compound ISIS Number 328759 (SEQ ID NO: 668), targeting the mir-216 miRNA, was observed to arrest or delay the cell cycle in G2/M-phase at both 24- and 48-hours after oligonucleotide treatment, suggesting that the mir-216 miRNA plays a role in regulating mitosis.

Treatment of HeLa cells with the oligomeric compound ISIS Number 328342 (SEQ ID NO: 451), targeting the mir-203 miRNA, was observed to arrest or delay the cell cycle in G2/M-phase at both 24- and 48-hours after oligonucleotide treatment, suggesting that the mir-203 miRNA plays a role in regulating mitosis.

Treatment of HeLa cells with the oligomeric compound ISIS Number 328707 (SEQ ID NO: 616), targeting miR-100-1 was also observed to arrest or delay cells mainly in the G2/M-phase at both 24- and 48-hours after oligonucleotide treatment, suggesting that the miR-100-1 miRNA plays a role in regulating mitosis.

Dose Responsiveness:

In accordance with the present invention, certain oligomeric compounds targeting miRNAs were selected for dose response studies. Using the cell cycle assay described above, the cell cycle profiles of HeLa or A549 cells treated with varying concentrations of oligomeric compounds of the present invention were assessed.

HeLa cells were treated with 25-, 50-, 100- or 150 nM of the oligomeric compounds ISIS Numbers 327902 (SEQ ID NO: 320) and 328383 (SEQ ID NO: 492), both targeted against mir-192, and ISIS 327905 (SEQ ID NO: 323), targeting mir-205, and ISIS 328403 (SEQ ID NO: 512), targeting mir-106. Cells treated with increasing concentrations of oligomeric compounds were compared to untreated cells, to assess the dose-dependency of the observed delay or arrest. The random-mer ISIS 29848 was used as a negative control.

Cells were prepared for flow cytometry 48-hours after oligonucleotide treatment, as described, supra. Oligomeric compounds targeted to miRNAs were tested in quadruplicate, and ISIS 29848 was tested in triplicate; data is presented as an average of the replicates. Results of these dose response studies are shown in Table 33, where data are expressed as percentage of cells in each phase.

TABLE 33

Dose response of oligomeric compounds targeting miRNAs on cell cycling (48 hours)

| ISIS # | Dose oligomeric compound | % cells in cell cycle phase | | | |
|---|---|---|---|---|---|
| | | SubG1 | G1 | S | G2/M | Aneuploid |
| Untreated control (UTC) | 25 nM | 1.3 | 56 | 24 | 20 | 12 |
| | 50 nM | 1.4 | 56 | 24 | 20 | 14 |
| | 100 nM | 1.6 | 57 | 24 | 19 | 11 |
| | 150 nM | 1.6 | 57 | 23 | 20 | 15 |
| 29848 | 25 nM | 2.0 | 55 | 25 | 20 | 12 |
| | 50 nM | 1.5 | 56 | 25 | 19 | 12 |
| | 100 nM | 3.2 | 52 | 28 | 20 | 13 |
| | 150 nM | 4.2 | 48 | 31 | 21 | 15 |
| 327902 | 25 nM | 1.6 | 57 | 23 | 19 | 13 |
| | 50 nM | 2.4 | 51 | 30 | 20 | 14 |
| | 100 nM | 3.1 | 43 | 30 | 27 | 11 |
| | 150 nM | 6.3 | 36 | 36 | 28 | 12 |
| 327905 | 25 nM | 1.7 | 57 | 24 | 18 | 12 |
| | 50 nM | 2.1 | 50 | 30 | 20 | 12 |
| | 100 nM | 2.5 | 46 | 30 | 24 | 14 |
| | 150 nM | 4.5 | 38 | 38 | 24 | 12 |
| 328383 | 25 nM | 1.9 | 57 | 25 | 18 | 12 |
| | 50 nM | 1.3 | 56 | 25 | 18 | 13 |
| | 100 nM | 9.3 | 36 | 34 | 30 | 10 |
| | 150 nM | 11.8 | 29 | 36 | 34 | 11 |
| 328403 | 25 nM | 1.5 | 58 | 24 | 18 | 13 |
| | 50 nM | 1.1 | 53 | 27 | 20 | 14 |
| | 100 nM | 3.5 | 48 | 29 | 23 | 11 |
| | 150 nM | 8.2 | 37 | 40 | 24 | 13 |

From these data, it was observed that 48-hours after treatment of HeLa cells with increasing doses of each of these four oligomeric compounds targeting miRNAs, a dose-responsive delay or arrest resulted, exhibited as an increasing percentage of cells in the S— and G2/M-phases of the cell cycle. Concomitant decreases in the percentage of cells in G1-phase of the cell cycle and increases in the percentage of hypodiploid (subG1) cells were also observed. Likewise, a dose-responsive G2/M delay or arrest was observed in A549 cells treated with 25-, 50-, 100-, or 150 nM of the oligomeric compounds ISIS 327902, ISIS 328383 and ISIS Number 328342.

In a further study, A549 cells were treated with 25-, 50-, 100- or 150 nM of the oligomeric compounds ISIS Numbers 338637 (SEQ ID NO: 464) targeted against mir-96, and ISIS 338769 (SEQ ID NO: 596) targeted against mir-130b, ISIS 338836 (SEQ ID NO:

663) targeted against mir-23a, and ISIS 340350 (SEQ ID NO: 855) targeted against mir-95 (Mourelatos). Cells treated with increasing concentrations of oligomeric compounds were compared to untreated cells, to assess the dose-responsiveness of the observed delay or arrest. The random-mer ISIS 29848 was used as a negative control. Cells were prepared for flow cytometry 24-hours after oligonucleotide treatment. Results of these dose response studies are shown in Table 34, where data are expressed as percentage of cells in each phase relative to the untreated control cells in that phase.

TABLE 34

Dose response of oligomeric compounds targeting miRNAs on cell cycling (24 hours)

| ISIS # | Dose oligomeric compound | % cells in cell cycle phase | | | | |
|---|---|---|---|---|---|---|
| | | SubG1 | G1 | S | G2/M | Aneuploid |
| 29848 | 25 nM | 90 | 121 | 86 | 87 | 76 |
| | 50 nM | 91 | 116 | 88 | 93 | 90 |
| | 100 nM | 272 | 125 | 74 | 112 | 116 |
| | 150 nM | 507 | 126 | 71 | 119 | 84 |
| 338637 | 25 nM | 89 | 100 | 99 | 101 | 99 |
| | 50 nM | 86 | 110 | 89 | 107 | 120 |
| | 100 nM | 67 | 126 | 73 | 115 | 146 |
| | 150 nM | 216 | 123 | 66 | 144 | 135 |
| 338769 | 25 nM | 62 | 101 | 94 | 114 | 101 |
| | 50 nM | 82 | 114 | 81 | 122 | 132 |
| | 100 nM | 130 | 124 | 75 | 113 | 157 |
| | 150 nM | 341 | 117 | 71 | 145 | 184 |
| 338836 | 25 nM | 76 | 97 | 103 | 97 | 99 |
| | 50 nM | 232 | 113 | 89 | 98 | 111 |
| | 100 nM | 68 | 117 | 80 | 116 | 153 |
| | 150 nM | 178 | 117 | 69 | 149 | 114 |
| 340350 | 25 nM | 91 | 102 | 100 | 95 | 120 |
| | 50 nM | 158 | 128 | 67 | 126 | 80 |
| | 100 nM | 267 | 125 | 60 | 155 | 107 |
| | 150 nM | 402 | 128 | 40 | 211 | 108 |

From these data, it was observed that 24-hours after treatment of A549 cells with increasing doses of the oligomeric compounds ISIS Numbers 338637 (SEQ ID NO: 464) targeted against mir-96, and ISIS 338769 (SEQ ID NO: 596) targeted against mir-130b, ISIS 338836 (SEQ ID NO: 663) targeted against mir-23a, and ISIS 340350 (SEQ ID NO:855) targeted against mir-95 (Mourelatos), a dose-responsive delay or arrest resulted, exhibited as an increasing percentage of cells in the G2/M-phases of the cell cycle. Concomittent decreases in the percentage of cells in S-phase of the cell cycle and increases in the percentage of hypodiploid (subG1) cells were also observed.

In further studies, additional cell lines were treated with oligomeric compounds targeted against miRNAs to assess the effects of each oligomeric compound on cell cycling. BJ, B16, T47D, and HeLa cells were cultured and transfected as described above. T47D cells are deficient in p53. T47Dp53 cells are T47D cells that have been transfected with and selected for maintenance of a plasmid that expresses a wild-type copy of the p53 gene (for example, pCMV-p53; Clontech, Palo Alto, Calif.), using standard laboratory procedures. BJ cells were treated with 200 nM of each oligomeric compound, and T47D, T47Dp53, HeLa, and B16 cells were treated with 150 nM of each oligomeric compound. The human foreskin fibroblast BJ cell line represents a non-cancer cell line, while HeLa, T47D, T47Dp53 cells and the mouse melanoma cell line B16-F10 represent cancerous cell lines. For comparison, oligomeric compounds ISIS 183891 (SEQ ID NO: 847) and ISIS 285717 (TCGGTTCTTTCCAAG-GCTGA; herein incorporated as SEQ ID NO: 857), both targeting the kinesin-like 1/Eg5 mRNA, involved in cell cycling, were used as positive controls. The random-mer ISIS 29848 was used as a negative control. Additionally, the oligomeric compounds ISIS Number 25690 (ATCCCTTTCT-TCCGCATGTG; herein incorporated as SEQ ID NO: 858) and ISIS Number 25691 (GCCAAGGCGTGACATGATAT; herein incorporated as SEQ ID NO: 859), targeted to nucleotides 3051-3070 and 3085-3104, respectively, of the mRNA encoding the Drosha RNase III (GenBank Accession NM_013235.2, incorporated herein as SEQ ID NO: 860) were also tested. ISIS Number 25690 and ISIS Number 25691 are 5-10-5 2'-MOE gapmer compounds, 20 nucleotides in length, with phosphorothioate internucleoside linkages throughout the oligomeric compound. All cytidine residues are 5-methylcytidines. Transfections were performed using the methods described herein. Cells were prepared for flow cytometry 48-hours after oligonucleotide treatment. Results of these studies are shown in Table 35, where data are expressed as percentage of cells in each phase relative to the untreated control cells in that phase.

TABLE 35

Effects of oligomeric compounds targeting miRNAs on cell cycling (48 hours)

| Cell line | ISIS # | SEQ ID NO | target | Sub G1 | G1 | S | G2/M | aneuploid |
|---|---|---|---|---|---|---|---|---|
| BJ | 29848 | 737 | N/A | 187 | 100 | 99 | 100 | 105 |
| B16 | 29848 | 737 | N/A | 143 | 98 | 98 | 110 | 99 |
| HeLa | 29848 | 737 | N/A | 403 | 83 | 113 | 106 | 155 |
| T47D | 29848 | 737 | N/A | 86 | 95 | 113 | 98 | 155 |
| T47Dp53 | 29848 | 737 | N/A | 173 | 121 | 75 | 97 | 93 |
| BJ | 183891 | 847 | kinesin-like 1/eg5 | 422 | 58 | 173 | 287 | 158 |
| B16 | 285717 | 857 | kinesin-like 1/eg5 | 627 | 72 | 78 | 220 | 178 |
| HeLa | 183891 | 847 | kinesin-like 1/eg5 | 1237 | 22 | 95 | 211 | 161 |
| T47D | 183891 | 847 | kinesin-like 1/eg5 | 85 | 55 | 84 | 156 | 161 |
| T47Dp53 | 183891 | 847 | kinesin-like 1/eg5 | 351 | 71 | 53 | 189 | 84 |
| HeLa | 25690 | 858 | Drosha, RNAse III | 64 | 119 | 89 | 87 | 140 |
| T47D | 25690 | 858 | Drosha, RNAse III | 97 | 97 | 80 | 113 | 140 |
| T47Dp53 | 25690 | 858 | Drosha, RNAse III | 193 | 97 | 108 | 114 | 144 |
| BJ | 25691 | 859 | Drosha, RNAse III | 183 | 94 | 116 | 125 | 209 |
| B16 | 25691 | 859 | Drosha, RNAse III | 316 | 116 | 83 | 99 | 105 |
| HeLa | 25691 | 859 | Drosha, RNAse III | 881 | 53 | 141 | 113 | 203 |
| T47D | 25691 | 859 | Drosha, RNAse III | 125 | 94 | 104 | 104 | 203 |
| T47Dp53 | 25691 | 859 | Drosha, RNAse III | 212 | 130 | 66 | 93 | 95 |
| HeLa | 338797 | 624 | hypothetical miRNA-144 | 144 | 104 | 89 | 115 | 125 |
| HeLa | 338666 | 493 | hypothetical miRNA 039 | 214 | 92 | 98 | 130 | 151 |
| HeLa | 338833 | 660 | hypothetical miRNA 181 | 255 | 87 | 100 | 136 | 136 |
| HeLa | 328707 | 616 | mir-100-1 | 125 | 103 | 87 | 122 | 140 |
| BJ | 328403 | 512 | mir-106 | 81 | 102 | 95 | 92 | 114 |
| B16 | 328403 | 512 | mir-106 | 112 | 111 | 88 | 99 | 92 |
| HeLa | 328403 | 512 | mir-106 | 89 | 125 | 89 | 80 | 175 |
| T47D | 328403 | 512 | mir-106 | 49 | 104 | 112 | 89 | 175 |
| T47Dp53 | 328403 | 512 | mir-106 | 140 | 114 | 87 | 94 | 89 |
| HeLa | 341787 | 852 | MiR-125a, Mouse | 324 | 88 | 96 | 145 | 177 |
| T47D | 328687 | 596 | mir-130b | 142 | 101 | 92 | 115 | 169 |
| T47Dp53 | 338769 | 596 | mir-130b | 116 | 103 | 87 | 123 | 87 |
| B16 | 327933 | 351 | mir-145 | 104 | 109 | 84 | 116 | 130 |
| BJ | 345395 | 351 | mir-145 | 132 | 100 | 97 | 104 | 115 |
| B16 | 345395 | 351 | mir-145 | 147 | 106 | 87 | 115 | 150 |
| HeLa | 345395 | 351 | mir-145 | 87 | 108 | 96 | 95 | 139 |
| BJ | 328744 | 653 | mir-182 | 125 | 94 | 111 | 127 | 158 |
| B16 | 328744 | 653 | mir-182 | 153 | 108 | 87 | 110 | 115 |
| HeLa | 328744 | 653 | mir-182 | 1057 | 53 | 110 | 213 | 178 |
| T47D | 328744 | 653 | mir-182 | 85 | 90 | 87 | 118 | 191 |
| T47Dp53 | 328744 | 653 | mir-182 | 90 | 130 | 59 | 101 | 100 |
| BJ | 327902 | 320 | mir-192-1 | 91 | 99 | 88 | 108 | 82 |
| B16 | 327902 | 320 | mir-192-1 | 151 | 112 | 88 | 98 | 101 |
| HeLa | 327902 | 320 | mir-192-1 | 94 | 108 | 96 | 93 | 162 |
| T47D | 327902 | 320 | mir-192-1 | 102 | 75 | 120 | 116 | 162 |
| T47Dp53 | 327902 | 320 | mir-192-1 | 155 | 100 | 98 | 102 | 97 |
| HeLa | 338665 | 492 | mir-192-1 | 322 | 92 | 92 | 142 | 138 |
| HeLa | 328342 | 451 | mir-203 | 103 | 96 | 89 | 138 | 96 |
| BJ | 327905 | 323 | mir-205 | 105 | 100 | 77 | 109 | 102 |
| B16 | 327905 | 323 | mir-205 | 142 | 107 | 89 | 106 | 94 |
| HeLa | 327905 | 323 | mir-205 | 55 | 108 | 99 | 90 | 164 |
| T47D | 327905 | 323 | mir-205 | 81 | 97 | 101 | 103 | 164 |
| T47Dp53 | 327905 | 323 | mir-205 | 109 | 112 | 80 | 104 | 103 |
| HeLa | 338678 | 505 | mir-205 | 129 | 103 | 94 | 105 | 132 |
| BJ | 328759 | 668 | mir-216 | 164 | 91 | 117 | 141 | 160 |
| B16 | 328759 | 668 | mir-216 | 132 | 104 | 91 | 110 | 126 |
| HeLa | 328759 | 668 | mir-216 | 797 | 40 | 82 | 203 | 223 |
| T47D | 328759 | 668 | mir-216 | 123 | 86 | 87 | 122 | 223 |
| T47Dp53 | 328759 | 668 | mir-216 | 423 | 99 | 93 | 108 | 109 |
| HeLa | 327896 | 314 | mir-22 | 95 | 103 | 94 | 106 | 144 |
| HeLa | 338836 | 660 | mir-23a | 303 | 97 | 96 | 121 | 114 |
| HeLa | 328084 | 743 | mir-30a | 286 | 89 | 92 | 153 | 125 |
| HeLa | 340350 | 855 | mir-95 (Mourelatos) | 132 | 101 | 94 | 112 | 177 |

When treatment of cells with oligomeric compounds resulted in greater than 750% cells in subG1 phase, these oligomeric compounds were deemed to be "hits," in that they appear to cause an increase in apoptosis, resulting in hypodiploid DNA contents. When treatment of cells with oligomeric compounds resulted in greater than 140% cells in G1-phase, these oligomeric compounds were deemed "hits," as they appeared to cause an arrest or delay in G1-phase and/or blocked entry into S-phase of the cell cycle. When treatment of cells with oligomeric compounds resulted in greater than 140% cells in S-phase, these oligomeric compounds were deemed "hits," as they appeared to cause an arrest or delay in DNA synthesis. When treatment of cells with oligomeric compounds resulted in greater than 140% cells in G2/M phase, these oligomeric compounds were deemed "hits," as they appeared to cause an arrest or delay in the transition into mitosis, and/or in cell division, itself.

From these data, it was observed that 48-hours after treatment of the various cell lines with the oligomeric compounds, ISIS Number 183891 targeting the kinesin-like 1/Eg5 mRNA results in a delay or arrest in G2/M phase of the cell cycle for all cell lines. Treatment of HeLa cells with ISIS Number 25691, targeted against the Drosha RNase III mRNA, resulted in an increased percentage of cells in S-phase as well as a significant percentage of cells in the subG1 and aneuploid categories, indicating that this oligomeric compound may interfere with DNA replication and/or maintenance of the integrity of the proper complement of genetic material.

In HeLa cells, ISIS 341787 (SEQ ID NO: 852) targeted against mir-125a (mouse), resulted in an arrest or delay in G2/M as well as an increased percentage of cells in the subG1 and aneuploid categories, indicating that this oligomeric compound may interfere with cell division and equal chromosome segregation during mitosis.

In HeLa cells treated with ISIS 328744 (SEQ ID NO: 653) targeted against mir-182, an increase in the percentage of cells in the G2/M-phase of the cell cycle as well as in the subG1 category was observed, indicating that this oligomeric compound may interfere with cell division and equal chromosome segregation during mitosis. Notably, genetically normal cells (BJ and T47Dp53cells) were not affected by ISIS Number 328744, indicating that the oligomeric compound targeting miR-182 may selectively cause a cell cycle delay or arrest in cancer cells and not normal cells, and suggesting that this compound may be particularly useful as a therapeutic agent in the treatment of hyperproliferative disorders such as cancer.

In HeLa cells treated with ISIS 328759 (SEQ ID NO: 668) targeted against mir-216, a delay or arrest resulted in the G2/M-phase of the cell cycle was observed, as well as an increase in the percentage of cells in the subG1 and aneuploid categories, indicating that this oligomeric compound may interfere with cell division and equal chromosome segregation during mitosis.

Thus, it was observed that treatment of HeLa cells with oligomeric compounds targeting miRNAs is a effective means of identifying compounds that can block progression through various stages of the cell cycle. Notably, a transient increase in G1-phase was observed 24 hours after treatment of HeLa cells with oligomeric compounds targeting miRNAs; for example, oligomeric compounds ISIS Numbers 338769, 338836, 340350, and 338637 caused a transient increase in the percentage of cells delayed or arrested in G1-phase at the 24-hour time point, which, by the 48-hour time point, had shifted to a delay or arrest in S-phase. It was also noted that multiple oligomeric compounds targeting the same miRNA have the same effect on cell cycling. It was also observed that uniform 2'-MOE as well as 2'-MOE chimeric gapmer oligomeric compounds targeting the mature miRNA, as well as uniform 2'-MOE oligomeric compounds targeting the pri-miRNA often have the same effect.

Oligomeric compounds that delay, arrest or prevent cell cycle progression or induce apoptosis may be useful as therapeutic agents for the treatment of hyperproliferative disorders, such as cancer, cancer, as well as diseases associated with a hyperactivated immune response.

It is understood that BJ, B16, HeLa, A549, HMECs, T47D, T47Dp53, MCF7 or other cell lines can be treated with oligomeric compounds designed to mimic miRNAs in studies to examine their effects on progression through the cell cycle. Such oligomeric compounds are within the scope of the present invention.

Example 25

A Bioinformatic Approach to Identification of miRNA Targets

Several candidate RNA transcripts identified using the RACE-PCR methods described in Example 20 were the basis for a bioinformatic analysis of predicted targets bound to and/or potentially regulated by miRNAs. The complementarity between the miRNA used as a primer and the 3'-UTR of the RNA transcript identified by RACE-PCR was assessed using several methods. Transcripts identified by RACE-PCR were also analyzed using the FASTA sequence alignment program (accessible through the internet at, for example, www.ebi.ac.uk/fasta33) to find the best alignment between complementary sequences of the transcript and the miRNA used as a primer for RACE-PCR. When, using the default parameters, the FASTA alignment program resulted in the identification of the actual primer binding site (PBS) within the 3'-UTR of the RNA transcript as the sequence most complementary to the miRNA used as a primer in the RACE-PCR method, the candidate miRNA target transcript was specified by a plus sign (for example, see the "mir-143/PBS complementary?" column in Table 36 below). When the FASTA program failed to align the actual PBS with the sequence most complementary to the miRNA used in the RACE-PCR, the candidate miRNA target transcript was specified by a minus sign. When the FASTA program could be made to align with the sequence most complementary to the miRNA used in the RACE-PCR by decreasing the stringency of the FASTA program parameters, the candidate miRNA target transcript was specified by "±".

A global alignment was also performed to assess whether the sequence of the PBS within the RNA transcript identified by RACE-PCR was conserved between human and mouse orthologs of the RNA target. For example, in Table 36, below, strong conservation of PBS in the human and murine orthologs (homology from 80-100%) was indicated by a plus sign; moderate conservation (homology between 70-80%) was indicated by "±", and a minus sign indicates homology below 70%.

A variety of algorithms can be used to predict RNA secondary structures based on thermodynamic parameters and energy calculations. For example, secondary structure prediction can be performed using either M-fold or RNA Structure 2.52. M-fold can be accessed through the Internet at, for example, www.ibc.wustl.edu/-zuker/ma/form2.cgi or can be downloaded for local use on UNIX platforms. M-fold is also available as a part of GCG package. RNA Structure 2.52 is a windows adaptation of the M-fold algorithm and can be accessed through the Internet at, for example, 128.151.176.70/RNAstructure.html. The RNA Structure 2.52 program was used to analyze a series of 30-base fragments spanning the entire length of the human RNA transcript and their potential to hybridize with the miRNA used as a primer in the RACE-PCR, allowing the prediction of the lowest absolute free energy peak representing the most likely site of hybridization (including bulged regions) between the miRNA and the RNA target. If the free energy peak representing the hybridization between the miRNA and the PBS of the RNA transcript identified by RACE-PCR was among the top five peaks predicted by the RNA Structure 2.52 program, the transcript was given a plus sign, "+". If the free energy peak representing the hybridization between the miRNA and the PBS was in the top five to ten peaks predicted by RNA Structure 2.52, the transcript was given a plus/minus sign, "±", and if the peak representing the hybridization between the miRNA and the PBS was below the top ten peaks predicted by RNA Structure 2.52, the transcript was given a minus sign, "−".

A list of the RNA transcript targets identified by RACE-PCR employing the mir-143 miRNA as a specific primer is shown in Table 36.

ing sites in target nucleic acids. Lin-4 has been experimentally determined to bind at a single site on the lin-28 mRNA. Herein, as a primary determinant of miRNA-target interactions, it was hypothesized that the bimolecular hybridization free energies ($\Delta G°_{37}$) of the interaction of the miRNA with a true target site would be more negative than the $\Delta G°_{37}$ of other interactions of the miRNA with other binding sites. The nucleotide sequence of the lin-28 mRNA was assessed by computationally deriving 30-nucleotide windows, starting with the first nucleotide of the sequence and defining the first nucleotide in each window by shifting 1 nucleotide in the 3' direction. Each window was assessed by hybridizing the 30-nucleotide sequence in the window with the lin-4 miRNA and disallowing unimolecular interactions, thereby spanning the entire length of the lin-28 mRNA, and the resulting $\Delta G°_{37}$ value was plotted against the start position of the window. It was observed that the bimolecular hybridization between the true lin-4 binding site and the lin-28 mRNA had the lowest $\Delta G°_{37}$ value, supporting our hypothesis and our bioinformatic approach to the identification of miRNA binding sites in target nucleic acids.

TABLE 36

Potential RNA targets of the mir-143 miRNA

| RNA transcript target | SEQ ID NO: | PBS conserved? | RNA Structure peak? | mir-143/PBS complementary? |
|---|---|---|---|---|
| Matrix metalloproteinase 2 | 819 | + | − | + |
| Sec24 | 829 | − | +/− | + |
| Tripartite motif-containing 32 | 828 | +/− | + | +/− |
| RAN | 824 | +/− | + | + |
| Cystatin B | 802 | − | + | + |
| Glucocorticoid induced transcript 1 | 839 | + | +/− | + |
| Protein phosphatase 2 | 809 | + | + | + |
| Polycystic kidney disease 2 | 822 | − | − | − |
| Mannose-6-phosphate receptor | 801 | +/− | − | + |
| Mitotic control protein dis3 homolog | 817 | + | + | − |
| Chromosome 14 ORF 103 | 813 | + | +/− | − |
| Rho GDP dissociation inhibitor beta | 823 | − | − | − |
| Glyoxalase I | 816 | + | + | + |
| Zinc finger protein 36, C3H type-like 1 | 818 | + | +/− | + |
| LIM domain only 4 | 804 | + | + | + |

Note that four genes (Sec24, cystatin B, polycystic kidney disease 2, and Rho GDP dissociation inhibitor beta) did not have murine orthologs to compare in a global analysis of the PBS. Because these RNA transcripts were identified as being bound by the mir-143 miRNA used as a primer in the RACE-PCR approach previously described, the mir-143 miRNA is predicted to serve a regulatory role in expression or activity of one or more or all of these RNA transcripts. Of particular note are three targets, protein phosphatase 2, glyoxalase I, and LIM domain only 4 (LMO4) mRNAs, for which all three analyses yielded a positive result. That all three parameters assessed yielded a positive result suggests that these mRNAs are probable targets of mir-143.

The well-studied C. elegans lin-4 miRNA interaction with its lin-28 mRNA target was used as the starting point for a bioinformatics approach to the identification of miRNA bind- The mitogen-activated protein kinase 7/extracellular signal-regulated kinase 5 (ERK5) (GenBank Accession NM_139032.1, incorporated herein as SEQ ID NO: 861) mRNA transcript was previously computationally predicted to be regulated by mir-143 miRNA binding in the 3'-UTR regions (Lewis et al., Cell, 2003, 115, 787-798). In order to identify mir-143 binding sites in the ERK5 mRNA, a bimolecular hybridization free energy assessment was performed by performing a hybridization walk to assess possible mir-143 binding sites along the entire length of the ERK5 mRNA. A strong negative $\Delta G°_{37}$ value (−20.1) was found at the previously predicted mir-143 binding site in the 3'-UTR, lending further support to our method. Surprisingly, two additional, and novel, mir-143 binding sites with more negative $\Delta G°_{37}$ values, as well as a third mir-143 binding site with a comparable $\Delta G°_{37}$ value were also identified. Using the ERK5 sequence (GenBank Accession NM_139032.1) as a reference, these binding sites encompass nucleotides 937-966 with a $\Delta G°_{37}$ value of (−22.8), nucleotides 2041-2070 with a $\Delta G°_{37}$ value of (−20.6) and nucleotides 2163-2192 with a $\Delta G°_{37}$ value of (−19.3). See FIG. 1. Thus, three novel mir-143 binding sites (and, thus, a potential regulatory sites) were identified within the coding sequence of the ERK5 gene. Thus, this method of screening for miRNA binding sites by a bimolecular hybridization free energy assessment can be used to confirm previously predicted sites, and further allows the identification of novel miRNA target nucleic acid binding sites. It is believed that this method may more closely mimic the energetic mechanism by which a miRNA scans a target nucleic acid to find its interaction site. In subsequent experiments, the predicted mir-143 binding sites within the ERK5 coding sequence were also tested using the reporter system described below.

Example 26

Northern Analysis of miRNA Expression

As described in the adipocyte differentiation assay, the oligomeric compounds ISIS Number 327889 (SEQ ID NO: 307), targeted to mir-23b, and ISIS Number 327876 (SEQ ID NO: 294), targeted to mir-29b-1, were found to reduce the expression of several hallmark genes of adipocyte differentiation, indicating that mir-23b and mir-29b-1 may play a role in adipocyte differentiation, and that oligomeric compounds targeting these miRNAs may be useful as agents blocking cellular differentiation. Therefore, the expression of mir-23b and mir-29b was assessed by Northern blot of total RNA from multiple tissues. To detect the mir-23b and mir-29b-1 targets, target specific DNA oligonucleotide probes with the sequences GTGGTAATCCCTGGCAATGTGAT (SEQ ID NO: 307) and AACACTGATTTCAAA TGGTGCTA (SEQ ID NO: 294), respectively, were synthesized by IDT (Coralville, Iowa). The oligo probes were 5' end-labeled with T4 polynucleotide kinase with ($\gamma$-$^{32}$P) ATP (Promega). To normalize for variations in loading and transfer efficiency membranes are stripped and probed for U6 RNA. Total RNA from mouse and human tissues as well as total RNA from human adipocytes and HepG2 cells was probed in Northern blot analyses, using methods described in Example 14.

By Northern analyses, the mir-23b miRNA was found to be most highly expressed in human kidney tissue as well as in adipose tissue from ob/ob mice, and was also highly expressed in human liver, adipocytes, preadipocytes and HepG2 cells. Moderate expression of mir-23b was also noted in murine kidney tissue. The mir-29b-1 miRNA was found to be most highly expressed in human and mouse kidney, and was also expressed in human liver, adipocytes, preadipocytes, and HepG2 cells, as well as in murine adipose tissue and liver. Levels of both the mir-23b and mir-29b-1 miRNAs were also found to be upregulated in human differentiated adipocytes.

Similarly, target specific DNA oligonucleotide probes for mir-16, mir-15a, and let-7a were designed and used in Northern blot analyses to assess expression of these miRNAs in human and mouse tissues. The mir-16 and mir-15a miRNAs were each found to be most highly expressed in human spleen, heart, testes, and kidney, and expression was also observed in liver as well as HEK293 and T47D cells. Additionally, low levels of expression of the mir-16 miRNA were observed in NT2 cells. The let-7a miRNA was most highly expressed in human and murine kidney, and expression was also observed in human and murine liver. Additionally, low levels of let-7a expression were found in HepG2 cells.

To detect the mir-21 miRNA in Northern blot analyses, a target specific DNA oligonucleotide probe with the sequences TCAACATCAGTCTGATAAGCTA (SEQ ID NO: 335) was synthesized by IDT (Coralville, Iowa). The oligo probes were 5' end-labeled with T4 polynucleotide kinase with ($\gamma$-$^{32}$P) ATP (Promega). Twenty micrograms of total RNA from human Promyelocytic Leukemia HL-60 cells, A549, HeLa, HEK293, T47D, HepG2, T-24, MCF7, and Jurkat cells was fractionated by electrophoresis through 15% acrylamide urea gels using a TBE buffer system (Invitrogen). RNA was transferred from the gel to HYBOND™-N+ nylon membranes (Amersham Pharmacia Biotech, Piscataway, N.J.) by electroblotting in an Xcell SureLock™ Minicell (Invitrogen). Membranes were fixed by UV cross-linking using a STRATALINKER™ UV Crosslinker 2400 (Stratagene, Inc, La Jolla, Calif.) and then probed using Rapid Hyb buffer solution (Amersham) using manufacturer's recommendations for oligonucleotide probes. To normalize for variations in loading and transfer efficiency membranes are stripped and probed for U6 RNA. High levels of expression of mir-21 were observed in A549 and HeLa cells; in fact, levels of mir-21 expression were noted to be among the highest of any of the miRNAs observed in HeLa cells.

Example 27

Reporter Systems for Assaying Activity of Oligomeric Compounds Targeting or Mimicking miRNAs Reporter systems have been developed herein to assess the ability of miRNA mimics to provoke a gene silencing response and to assess whether antisense oligomeric compounds targeting miRNAs can inhibit gene silencing activity. The T-REx™-HeLa cell line (Invitrogen Corp., Carlsbad, Calif.) was used for either stable or transient transfections with plasmids constitutively expressing miRNAs, pre-miRNAs, pri-miRNAs or mimics thereof, and, in some cases, antisense oligomeric compounds targeting the expressed miRNA were also transfected into the cells. It is understood that other mammalian cells lines can also be used in this reporter system. T-REx™-HeLa cells were routinely cultured in DMEM, high glucose (Invitrogen Corporation, Carlsbad, Calif.), supplemented with 10% fetal bovine serum (Invitrogen Corporation). Cells were routinely passaged by trypsinization and dilution when they reached 90% confluence. Cells were harvested when they reached 90% confluence, and on the day before transfection with expression or reporter plasmids (described in detail below), the T-REx™-HeLa cells were seeded onto 24-well plates at 50,000 cells/well. The following day, cells were transfected according to standard published procedures with various combinations of plasmids using 2 µg Lipofectamine™ 2000 Reagent (Invitrogen) per µg of plasmid DNA. When transfecting oligomeric compounds, 1-3 µg of Lipofectamine™ 2000 Reagent was used per 100 nM oligomeric compound.

Plasmids used are as follows: The pcDNA3.1©/NT-GFP (Invitrogen) plasmid, containing a CMV promoter controlling expression of a GFP reporter sequence at the N-terminus of the transcription start site was used as a control plasmid. The pcDNA3.1©/NT-GFP-mir-143 sensor plasmid contains (in addition to the elements above) three 22-nucleotide sites encoding the mir-143 miRNA binding site, downstream of the GFP coding sequence and upstream of the polyadenylation signal. The pCR3-pri-mir-143 plasmid ("pri-mir-143") is a CMV promoter-driven constitutive expression plasmid which expresses the 110-nucleotide mir-143 pri-miRNA sequence (SEQ ID NO: 38), to act as a mir-143 pri-miRNA mimic. The pCR3-pri-mir control ("pri-mir-control") is a CMV promotor-driven constitutive expression plasmid which is designed to express a similar 110-nucleotide pri-miRNA sequence (AGCAGCGCAGCGCCCTGTCTC-CCAGCCAAGGTGGAACCTTCTGGGAAGCGGTCAG TTGGGAGTCCCTTCCCTGAAGGTTCCTCCTTGGAA GAGAGAAGTTG TTCTGCAGC; SEQ ID NO: 862) wherein the mature mir-143 sequence has been replaced with an unrelated sequence and the predicted complementary strand opposite it within the pri-miRNA structure is replaced with a nearly complementary sequence in order to preserve the stem loop as well as the bulge structure of the natural mir-143 pri-miRNA. Additionally, in order to test the effect of an oligomeric compound targeting a miRNA, the T-REx™-HeLa cells were also transfected with the uniform 2'-MOE phosphorothioate (PS) antisense oligomeric compound ISIS Number 327901 (SEQ ID NO: 319), targeted to mir-143 previously described.

Twenty-four hours post-transfection, cells were trypsinized and GFP fluorescence was analyzed by flow cytometry. Results are shown in Table 37.

TABLE 37

Mean GFP fluorescence after transfection of T-REx ™-HeLa cells

| Treatment | | | | | Mean |
|---|---|---|---|---|---|
| pri-mir control | pri-mir-143 | GFP control | GFP mir-143 sensor | 327901 oligo | fluorescence |
| − | − | − | − | − | 2.2 |
| + | − | − | − | − | 2.7 |
| − | + | − | − | − | 2.6 |
| − | − | + | − | − | 7.9 |
| + | − | + | − | − | 22.7 |
| − | + | + | − | − | 9.6 |
| − | − | − | + | − | 12.4 |
| + | − | − | + | − | 21.8 |
| − | + | − | + | − | 5.3 |
| − | + | − | + | + | 4.1 |
| − | − | − | + | + | 4.2 |
| − | + | − | − | + | 3.7 |

Plus signs, "+", indicate the presence of the expression plasmid or oligomeric construct in transfectants; minus signs "−", indicate the absence of same. Mean fluorescence is measured in arbitrary units.

In cells transfected with the sensor plasmid and expressing the mir-143 pri-miRNA mimic from the pCR3-pri-mir-143 plasmid, the mir-143 miRNA is expected to be processed endogenously, allowing it to bind as a mature miRNA to the RNA transcript encoding GFP and containing the mir-143 binding sites expressed from the reporter plasmid, resulting in cleavage of the reporter transcript and a decrease in fluorescence as compared to the control plasmid. From the data shown in Table 37, it was observed that expression of the pCR3-pri-mir-143 plasmid results in an inhibition of expression of GFP indicated by a decrease in fluorescence produced by the pcDNA3.1©/NT-GFP-mir-143 sensor plasmid, whereas expression of the pCR3-pri-mir control plasmid had no effect on GFP reporter expression. Neither the pCR3-pri-mir control nor the pCR3-pri-mir-143 plasmid had any inhibitory effect on GFP expression from the pcDNA3. 1©/NT-GFP control plasmid. Thus, the mir-143 pri-miRNA mimic oligomeric compound silences the expression of RNA transcribed from a reporter plasmid containing mir-143 target sites.

In a further study, T-REx™-HeLa cells transfected with the pcDNA3.1©/NT-GFP-mir-143 sensor plasmid were treated at various dosages with the following oligomeric compounds: 1) a double-stranded RNA oligomeric compound ("ds-mir-143") composed of ISIS Number 342199 (TGAGATGAAG-CACTGTAGCTCA; SEQ ID NO: 220) representing the mir-143 sense sequence, hybridized to its perfect complement ISIS Number 342200 (TGAGCTACAGTGCTTCATCTCA; SEQ ID NO: 319); 2) a negative control dsRNA ("ds-Control"), representing a 10-base mismatched sequence antisense to the unrelated PTP1B mRNA, composed of ISIS Number 342427 (CCTTCCCTGAAGGTTCCTCC; SEQ ID NO: 863) hybridized to its perfect complement ISIS Number 342430 (GGAGGAACCTTCAG GGAAGG; SEQ ID NO: 864); 3) the pCR3-pri-mir-143 expression plasmid ("pCR3-pri-mir-143") which expresses the 110-nucleotide mir-143 pri-miRNA; 4) the pCR3-pri-mir control ("pri-mir-control"); 5) an in vitro transcribed RNA oligomeric compound ("hairpin mir-143") representing the 110 bp fragment of the mir-143 pri-miRNA molecule (SEQ ID NO: 38) plus an additional two cytosine nucleobases from the T7 promoter at the 5' end; and 6) an in vitro transcribed RNA oligomeric compound ("hairpin control") (SEQ ID NO: 862) representing a similar hairpin structure except that the mature mir-143 sequence and its complementary sequence within the pri-miRNA hairpin structure were replaced with sequences unrelated to mir-143. The RNA hairpin oligomeric compounds were in vitro transcribed using the MAXIscript Kit (Ambion Inc., Austin, Tex.) according to the manufacturer's protocol, beginning with a DNA template amplified by PCR. GFP fluorescence of treated cells was assessed using the methods described above, and it was observed that the ds-mir-143 oligomeric compound mimic inhibited expression of GFP from the sensor plasmid in a dose dependent manner. In a further embodiment, pcDNA3.1©/NT-GFP-mir-143 sensor-expressing cells treated with 20 nM mir-143 dsRNA oligomeric compound were additionally treated with 4-, 20- or 100 nM uniform 2'-MOE oligomeric compound ISIS Number 327901 (SEQ ID NO: 319), or 4-, 20- or 100 nM uniform 2'-MOE scrambled mir-143 control ISIS Number 342673 (SEQ ID NO: 758) to assess the ability of compounds to inhibit the inhibitory effect of the mir-143 dsRNA mimic. At all three concentrations, the oligomeric compound ISIS Number 327901 targeting mir-143 blocked the inhibitory effect of the mir-143 dsRNA oligomeric compound, exhibited as a recovery of GFP fluorescence.

In one embodiment, an expression system based on the pGL3-Control (Promega Corp., Madison Wis.) vector containing a CMV promoter controlling expression of a luciferase reporter sequence was used in transient transfections of HeLa cells with plasmids expressing miRNA or pri-miRNA mimics. To assess the ability of miRNA mimics to bind and regulate the expression of the luciferase reporter gene, two reporter plasmids were constructed: 1) a synthetic DNA fragment comprising two sites perfectly complementary to mir-143 were inserted into the pGL3-Control luciferase reporter vector, to create the pGL3-mir-143 sensor plasmid, and 2) a DNA fragment comprising the 3'-UTR of the LIM domain only 4 (LMO4) gene (predicted to be regulated by mir-143) was inserted into pGL3-Control to create pGL3-LMO4; this fragment was PCR-amplified using a primer beginning at position 1261 of the LMO4 sequence (GenBank Accession NM_006769.2, incorporated herein as SEQ ID: 809) and the downstream primer hybridizing to the poly-A tail. In each of these plasmids, the target site was placed downstream of the luciferase coding sequence and upstream of the polyadenylation signal in the 3'-UTR of the luciferase reporter vector. The unmodified pGL3-Control luciferase reporter vector was used as a control.

HeLa cells were routinely cultured and passaged as described, and on the day before transfection with expression or reporter plasmids, the HeLa cells were seeded onto 24-well plates 50,000 cells/well. Cells were transfected according to standard published procedures with various combinations of plasmids using 2 µg Lipofectamine™ 2000 Reagent (Invitrogen) per µg of plasmid DNA, or, when transfecting oligomeric compounds, 1.25 µg of Lipofectamine™ 2000 Reagent per 100 nM oligonucleotide or double-stranded RNA. The luciferase signal in each well was normalized to the Renilla luciferase (RL) activity produced from a co-transfected plasmid, pRL-CMV, which was transfected at 0.5 µg per well. Cells were treated at various dosages (4 nM, 20 nM, and 100 nM) with the following oligomeric compound mimics: 1) "ds-mir-143," 2) "ds-Control," 3) "pCR3-pri-mir-143," or 4) "pri-mir-control," as described supra. In accordance with methods described in Example 12, supra, a luciferase assay was performed 48-hours after transfection. Briefly, cells were lysed in passive lysis buffer (PLB; Promega), and 20 ul of the lysate was then assayed for RL activity using a Dual Luciferase Assay kit (Promega) according to the manufacturer's protocol. The results below are an average of three trials and are presented as percent pGL3-Control luciferase expression normalized to pRL-CMV expression (RL). The data are shown in Table 38.

TABLE 38

Luciferase assays showing effects of oligomeric compounds mimicking mir-143

| treatment | luciferase expression (% lucif. only control) | | |
|---|---|---|---|
| | pGL3-Control | pGL3-mir-143 sensor | pGL3-LMO4 |
| no luciferase (pRL) | 0.3 | 0.3 | 0.4 |
| luciferase (pRL) only | 100.0 | 101.0 | 100.0 |
| ds-mir-143 (4 nM) | 101.5 | 14.5 | 151.6 |
| ds-mir-143 (20 nM) | 123.8 | 8.0 | 140.1 |
| ds-mir-143 (100 nM) | 131.8 | 7.1 | 128.4 |
| ds-Control (4 nM) | 133.6 | 144.5 | 172.4 |
| ds-Control (20 nM) | 126.1 | 169.8 | 151.6 |
| ds-Control (100 nM) | 123.0 | 151.3 | 151.5 |
| pCR3-pri-mir-143 (0.25 ug) | 75.6 | 58.6 | 101.9 |
| pCR3-pri-mir-143 precursor (0.5 ug) | 76.6 | 50.7 | 95.7 |
| pCR3-pri-mir-143 (1 ug) | 64.7 | 35.0 | 82.5 |
| pri-mir control (0.25 ug) | 90.3 | 78.3 | 114.8 |
| pri-mir control (0.5 ug) | 57.3 | 61.8 | 95.4 |
| pri-mir control (1 ug) | 67.9 | 64.9 | 74.8 |

From these data, it was observed that the mir-143 dsRNA oligomeric compound and the mir-143 pri-miRNA mimic expressed from the pCR3-pri-mir-143 expression plasmid both inhibited luciferase activity from the pGL3-mir-143 sensor plasmid in a dose-dependent manner.

In another embodiment, HeLa cells were transfected with 0.03 µg pGL3-mir-143 sensor plasmid and 0.01 µg pRL-CMV plasmid, and, in addition, (except those samples described below as "without mir-143 pri-miRNA,") were also transfected with 0.01 µg of an expression plasmid designed to express a mir-143 pri-miRNA mimic comprising a larger 430-nt fragment of the mir-143 primary miRNA transcript, referred to as "pCR3-pri-mir-143 (430)" (AGGTTTGGTCCTGGGTGCTCAAATGGCAGGCCACAGACAGGAAACACAG TTGTGAGGAATTACAACAGCCTCCCGGCCAGAGCTGGAGAGGTGGAGCCCAGGTCCCCTCTAACACCCCTTCTCCTGGCCAGGTTGGAGTCCCGCCACAGGCCACCAGA GCGGAGCAGCGCAGCGCCCTGTCTCCCAGCCTGAGGTGCAGTGCTGCATCTCTGG TCAGTTGGGAGTCTGAGATGAAGCACTGTAGCTCAGGAAGAGAGAAGTTGTTCT GCAGCCATCAGCCTGGAAGTGGTAAGTGCTGGGGGGTTGTGGGGGGCCATAACA GGAAGGACAGAGTGTTTCCAGACTCCATACTATCAGCCACTTGTGATGCTGGGG AAGTTCCTCTACACAAGTTCCCCTGGTGCCACGATCTGCTTCACGAGTCTGGGCA; SEQ ID NO: 871). It was observed that the mir-143 pri-miRNA mimic expressed by pCR3-pri-mir-143 (430) inhibits luciferase expression from the pGL3-mir-143 sensor plasmid. To further evaluate the ability of the mir-143 pri-miRNA mimic to inhibit luciferase activity from the sensor plasmid, and to assess the ability of oligomeric compounds to interfere with the inhibition of pGL3-mir-143 sensor luciferase expression by the mir-143 pri-miRNA mimic, pGL3-mir-143 sensor-expressing HeLa cells treated with pCR3-pri-mir-143 (430) were additionally treated with varying concentrations (0-, 6.7- or 20 nM) of the following oligomeric compounds: 1) ISIS Number 327901 (SEQ ID NO: 319), a uniform 2'-MOE oligomeric compound targeting mir-143; 2) ISIS Number 342673 (SEQ ID NO: 758), a uniform 2'-MOE scrambled control; or 3) ISIS Number 327924 (SEQ ID NO: 342) targeting an unrelated miRNA (mir-129-2). ISIS Numbers 342673 and 327924 were used as negative controls. HeLa cells transfected with the pRL-CMV and pGL3-mir-143 sensor plasmids, but not treated with the pCR3-pri-mir-143 (430) hairpin precursor served as a control. In this experiment, the luciferase assay was performed 24-hours after transfection. The data are presented in Table 39 as relative luciferase activity (normalized to RL expression levels). Where present, "N.D." indicates "no data."

TABLE 39

Effects of oligomeric compounds on mir-143 pri-miRNA mimic-mediated inhibition of luciferase expression

| | | Relative luciferase activity Dose of oligomeric compound | | |
|---|---|---|---|---|
| Treatment | SEQ ID NO | 0 nM | 6.7 nM | 20 nM |
| 327901 | 319 | 0.97 | 4.0 | 6.4 |
| 342673 negative control | 758 | 0.97 | 1.3 | 1.5 |
| 327924 negative control | 342 | 0.97 | 0.8 | 1.2 |
| without pCR3-pri-mir-143 (430) | N/A | 13.8 | N.D. | N.D. |

From these data, it was observed that the oligomeric compound ISIS Number 327901 targeting mir-143 blocked the inhibitory effect of the mir-143 pri-miRNA mimic, exhibited as a 4- to 6.4-fold recovery of luciferase activity in HeLa cells expressing the pGL3-mir-143 sensor plasmid.

More than four-hundred target genes have been predicted to be regulated by miRNA binding to the 3'-UTR regions of the mRNA transcript (Lewis et al., *Cell*, 2003, 115, 787-798). For example, at least six genes have been reported to bear regulatory sequences in their 3'-UTRs which are predicted to be bound by the mir-143 miRNA; these include the inwardly rectifying potassium channel Kir2.2 (GenBank Accession AB074970, incorporated herein as SEQ ID NO: 872), synaptotagmin III (GenBank Accession BC028379, incorporated herein as SEQ ID NO: 873), mitogen-activated protein kinase 7/extracellular signal-regulated kinase 5 (ERK5) (GenBank Accession NM_139032.1, SEQ ID NO: 861), protein phosphatase 2 (formerly 2A), catalytic subunit, beta isoform (PPP2CB) (GenBank Accession NM_004156.1, SEQ ID NO: 814), glyoxalase I (GLO1) (GenBank Accession NM_006708.1, SEQ ID NO: 821), and LIM domain only 4

(LMO4) (GenBank Accession NM_006769.2, SEQ ID NO: 809). It should be noted that one third of miRNA targets predicted in the study by Lewis, et al. are expected to be false positives (Lewis et al., Cell, 2003, 115, 787-798).

Because the present inventors independently identified the PPP2CB and GLO 1 genes as potential targets of mir-143 by the RACE-PCR methods as described in Example 20, these targets were selected for further study. In addition, and described in Example 25, a novel mir-143 binding site (and, thus, a potential regulatory site) was identified within the coding sequence of the ERK5 gene; this predicted mir-143 binding site within the ERK5 coding sequence was also tested in these reporter systems.

In some embodiments, an expression system based on the pGL3-Control (Promega Corp., Madison Wisc.) reporter vector and comprising predicted miRNA binding sites was used in stable transfections of HeLa cells, selecting for cells that have integrated the reporter plasmid into their genome. Because pGL3-based reporter vectors have no selectable marker for antibiotic resistance, a neomycin-resistance (Genetecin) gene was cloned into the pCR2 plasmid (Invitrogen Life Technologies, Carlsbad, Calif.) to create the pCR2-neo plasmid, and pCR2-neo was co-transfected into HeLa cells with the pGL3-mir-143-sensor plasmid at a ratio of one pCR2-neo plasmid to ten pGL3-mir-143-sensor plasmids. Co-transfected cells were then selected for the presence of the Genetecin marker and assayed for luciferase activity; Genetecin-resistant cells are very likely to have also integrated the luciferase reporter into their genome.

Establishment of Stably-Transfected Cells:

One day prior to transfection, approximately 750,000 HeLa cells are seeded onto a 10 cm dish or T-75 flask and grown in complete medium overnight at 37° C. The next day, 10 µg of pGL3-mir-143-sensor plasmid and 1 µg pCR2-neo are mixed in 2 ml OPTI-MEM™ (Invitrogen Corporation, Carlsbad, Calif.). (Linearization of circular plasmids by digestion with restriction enzyme may increase the number of stable transfectants per µg transforming DNA, but is not an essential step). 10 µl LIPOFECTIN™ reagent (Invitrogen Corporation, Carlsbad, Calif.) is mixed with 2 ml OPTI-MEM™. The plasmid/OPTI-MEM™ and OPTI-MEM™/LIPOFECTIN™ mixtures are then mixed together, and an additional 11 ml OPTI-MEM™ is added, and the resulting 15 ml cocktail is added to the cells. Cells are incubated in the plasmid/OPTI-MEM™/LIPOFECTIN™ cocktail for approximately 4 hours at 37° C., after which the cocktail is removed and replaced with fresh complete medium. The following day, cells are trypsinized and transferred to a T-175 flask. Media containing the selection agent, 500 µg/ml G418 (Geneticin; GIBCO/Life Technologies, Gaithersburg, Md.), is added and cells are grown at 37° C. Cells are re-fed daily with fresh media containing the selection agent until the majority of the cells appear to have died off and isolated colonies of neomycin-resistant cells appear. In cases where subcloning is desired, selected neomycin-resistant cells are trypsinized and plated at a concentration of 0.5 cells/well in 96-well plates, maintaining the cells in 500 µg/ml G418 selection media.

In one embodiment, five stably-transfected, neomycin-resistant, luciferase-positive, pGL3-mir-143-sensor cell clones were isolated, subcloned and selected for further testing with oligomeric compounds of the present invention. Cells stably expressing the luciferase reporter and comprising one or more miRNA binding sites were then transfected with oligomeric compounds mimicking miRNAs, pre-miRNAs or pri-miRNAs in order to assess the ability of these miRNA mimics to bind and regulate the expression of the luciferase reporter.

An expression system based on the pGL3-Control (Promega Corp., Madison Wisc.) reporter vector and comprising predicted miRNA binding sites was used in transient transfections of HeLa cells with plasmids expressing oligomeric compounds mimicking miRNAs, pre-miRNAs or pri-miRNAs in order to assess the ability of these miRNA mimics to bind and regulate the expression of the luciferase reporter. The effect of increasing the copy number of the miRNA-binding site in the target was also tested by including multiple binding sites in artificial reporter constructs. It is understood that the presence of multiple miRNA-binding sites in a target can include binding sites for different miRNAs.

The following reporter plasmids were constructed by cloning the specified fragment into the XbaI site of the pGL3-control plasmid, placing the potential miRNA-binding site in the 3'-UTR of the luciferase reporter: The reporter plasmid pGL3-bulge(x3) contains three contiguous copies of the sequence (TGAGCTACAGCTTCATCTCA; herein incorporated as SEQ ID NO: 874) which represents a sequence complementary to the mir-143 miRNA except that it is missing 2 nucleotides such that the mir-143 miRNA is presumed to adopt a bulged structure when it hybridizes to this target sequence. The pGL3-GLO1 reporter plasmid contains a DNA fragment comprising the 3'-UTR of the GLO1 sequence; this fragment was PCR-amplified using a primer beginning at nucleotide number 621 of the GLO1 sequence (GenBank Accession NM_006708.1, SEQ ID NO: 821) and the downstream primer hybridizing to the poly A tail. The pGL3-PP2A reporter plasmid contains a DNA fragment comprising the 3'-UTR of the PP2A gene; this fragment was PCR-amplified using a primer beginning at nucleotide number 921 of the PP2A sequence (GenBank Accession NM_004156.1) and the downstream primer hybridizing to the poly A tail. The reporter plasmid pGL3-ERK5-3'-UTR(x1) contains one copy of the sequence TATTCTGCAGG TTCATCTCAG (herein incorporated as SEQ ID NO: 875), found in the 3'-UTR of ERK5 and predicted by Lewis, et al. to be bound by the mir-143 miRNA, and the reporter plasmid pGL3-ERK5-3'UTR(x3) has three contiguous copies of this sequence. The reporter plasmid pGL3-ERK5-3'UTR(ext) contains one copy of the sequence CGGCTTGGATTATTCT GCAGGT-TCATCTCAGACCCACCTTT (herein incorporated as SEQ ID NO: 876), which includes an additional ten nucleotides at either end of the mir-143 binding site in 3'-UTR of ERK5 predicted by Lewis, et al. (Lewis et al., Cell, 2003, 115, 787-798). The plasmids pGL3-ERK5-cds(x1), pGL3-ERK5-cds(x2), pGL3-ERK5-cds(x3), and pGL3-ERK5-cds (x5contain one, two, three or five contiguous copies, respectively, of the novel mir-143 binding site (TTGAGCCCAGCGCTCGCATCTCA; herein incorporated as SEQ ID NO: 877) we identified within the coding sequence of ERK5. The unmodified pGL3-Control luciferase reporter vector was used as a negative control, and the pGL3-mir-143 sensor reporter plasmid was used as a positive control.

HeLa cells were routinely cultured and passaged as described. In some embodiments, HeLa cells were transfected with 0.05 µg of the relevant pGL3-sensor plasmid and 0.01 µg pRL-CMV plasmid. Additionally, in some embodiments, cells were treated at various dosages (11 nM, 33 nM, and 100 nM) with the following oligomeric compound mimics: 1) ds-mir-143, or 2) ds-Control as described. In accordance with methods described in Example 12, a luciferase assay was performed 24-hours after transfection. The results, shown in Tables 40 and 41, are an average of three trials. Data are presented as percent untreated control (luciferase plasmid only, not treated with oligomeric compound) luciferase expression, normalized to pRL-CMV levels.

TABLE 40

Effects of oligomeric compounds mimicking mir-143 on luciferase expression

| Reporter plasmid | ds-mir-143 | | | ds-control | | |
|---|---|---|---|---|---|---|
| | 11 nM | 33 nM | 100 nM | 11 nM | 33 nM | 100 nM |
| pGL3-Control | 90.7 | 94.2 | 72.5 | 113.4 | 79.6 | 87.0 |
| pGL3-bulge (x3) | 50.7 | 35.4 | 17.2 | 111.3 | 82.6 | 84.7 |
| pGL3-ERK5-3'UTR(x1) | 81.9 | 84.7 | 62.2 | 103.2 | 79.6 | 77.6 |

From these data, it was observed that, while treatment of HeLa cells expressing the reporter plasmids with the ds-control did not appear to significantly affect luciferase expression, the mir-143 dsRNA mimic compound inhibited luciferase activity from the pGL3-bulge(x3) sensor plasmid in a dose-dependent manner.

TABLE 41

Effects of oligomeric compounds mimicking mir-143 on luciferase expression

| Reporter plasmid | ds-mir-143 | | | ds-control | | |
|---|---|---|---|---|---|---|
| | 11 nM | 33 nM | 100 nM | 11 nM | 33 nM | 100 nM |
| pGL3-Control | 110.2 | 124.3 | 92.3 | 114.1 | 95.6 | 103.0 |
| pGL3-mir-143 sensor | 15.0 | 15.0 | 11.1 | 114.5 | 108.9 | 97.1 |
| pGL3-bulge(x3) | 36.1 | 33.9 | 22.2 | 109.5 | 103.2 | 92.4 |
| pGL3-ERK5-3'UTR(x1) | 92.2 | 108.1 | 81.9 | 106.2 | 99.6 | 90.1 |
| pGL3-ERK5-3'UTR(x3) | 51.7 | 51.0 | 28.2 | 104.6 | 103.4 | 95.7 |
| pGL3-ERK5-cds(x1) | 101.3 | 115.4 | 77.4 | 100.6 | 102.1 | 96.2 |
| pGL3-ERK5-cds(x2) | 92.7 | 113.8 | 63.6 | 111.3 | 99.2 | 90.4 |
| pGL3-ERK5-cds(x3) | 73.5 | 77.9 | 49.4 | 105.2 | 96.6 | 79.9 |
| pGL3-ERK5-cds(x5) | 49.4 | 44.5 | 23.9 | 103.0 | 113.4 | 89.9 |
| pGL3-ERK5-3'UTR(ext) | 89.0 | 106.7 | 81.4 | 96.8 | 108.9 | 89.4 |

From these data it was observed that treatment of HeLa cells expressing the pGL3-bulge(x3) reporter plasmid with the ds-mir-143 miRNA mimic oligomeric compound resulted in a dose-dependent inhibition of luciferase activity while the ds-control oligomeric compound had no effect as described previously. Treatment of HeLa cells expressing the pGL3-ERK5-3'UTR(x1) (containing one copy of the mir-143 binding site predicted by Lewis, et al.) with the ds-mir-143 mimic oligomeric compound did not inhibit luciferase activity, although increasing the number of potential mir-143 binding sites in the pGL3-ERK5-3'UTR(x3) reporter plasmid to three appeared to favor the binding of the ds-mir-143 mimic and inhibition of luciferase activity. Treatment of cells expressing the pGL3-ERK5- cds(x1) or pGL3-ERK5-cds(x2) reporter plasmids bearing a one or two copies, respectively, of the novel mir-143 binding site identified in the coding sequence of the ERK5 gene with 11- or 33 nM of the ds-mir-143 mimic oligomeric compound did not appear to inhibit luciferase activity, although treatment with 100 nM of the ds-mir-143 mimic did reduce luciferase expression. Treatment of cells expressing the pGL3-ERK5-cds(x3) or pGL3-ERK5-cds(x5) reporter plasmids, bearing three or five of copies, respectively, of the novel mir-143 binding site in the ERK5 coding sequence, with the ds-mir-143 mimic oligomeric compound resulted in a reduction in luciferase activity. The pGL3-ERK5-cds(x5) reporter plasmid exhibited a dose-responsiveness with increasing concentration of the mir-143 mimic oligomeric compound. Taken together, these results support the conclusion that multiple miRNAs and miRNA binding sites may cooperate to silence gene expression.

In order to assess the ability of miRNAs to bind predicted miRNA binding sites and regulate the expression of the luciferase reporter, in some embodiments, expression systems based on the pGL3-Control (Promega Corp., Madison Wisc.) reporter vector and comprising either a mir-15a, mir-21, or a mir-23b miRNA binding site were developed and used in transient transfections of HeLa cells to determine whether the endogenous mir-15 a, mir-2 1, or mir-23b miRNAs, respectively, could repress luciferase reporter gene expression.

The pGL3-mir-15a sensor plasmid was created by cloning the sequence (CACAAACCATTATGTGCTGCTA; SEQ ID NO: 369), complementary to the mir-15a miRNA, into the Xba site of the pGL3-Control plasmid, placing the potential miRNA-binding site in the 3'UTR of the luciferase reporter. This reporter plasmid was used to transfect HeLa cells and it was observed that the endogenous mir-15 a miRNA was able to inhibit luciferase expression from the pGL3-mir-15 a sensor plasmid. Thus, to further evaluate the ability of the mir-15a miRNA to bind this target site encoded by the pGL3-mir-15a sensor plasmid, and to assess the ability of oligomeric compounds to interfere with mir-15a-mediated silencing, pGL3-mir-15a sensor-expressing HeLa cells were treated with varying concentrations (3-, 10- or 30 nM) of the following oligomeric compounds: ISIS Number 327951 (SEQ ID NO: 369) is a uniform 2'-MOE compound targeting the mature mir-15a-1 miRNA. ISIS Numbers 356213 (SEQ ID NO: 878), 356215 (SEQ ID NO: 879), 356216 (SEQ ID NO: 880), 356218 (SEQ ID NO: 881), 356221 (SEQ ID NO: 882), 356227 (SEQ ID NO: 883) and 356229 (SEQ ID NO: 884) are phosphorothioate, uniform 2'-MOE oligomeric compounds designed and synthesized to target the entire length of the mir-15a pri-miRNA molecule (described in detail in Example 28, below). The uniform 2'-MOE phosphorothioate oligomeric compounds ISIS Number 327901 (SEQ ID NO: 319), targeting an unrelated miRNA (mir-143) and ISIS Number 342673 (AGACTAGCGGTATCTTTATCCC; herein incorporated as SEQ ID NO: 758), containing 15 mismatches with respect to the mature mir-143 miRNA, were used as negative controls. The data presented in Table 42 are the average of three trials and are presented as percent untreated control (luciferase plasmid only, not treated with oligomeric compound) luciferase expression, normalized to pRL-CMV levels.

TABLE 42

Effects of oligomeric compounds on mir-15a miRNA-mediated inhibition of luciferase expression

| Treatment | SEQ ID NO | Relative luciferase activity Dose of oligomeric compound | | |
|---|---|---|---|---|
| | | 3 nM | 10 nM | 30 nM |
| 327901 negative control | 319 | 83.6 | 96.6 | 88.2 |
| 342673 negative control | 758 | 104.5 | 82.6 | 85.7 |
| 327951 | 369 | 151.0 | 207.6 | 137.1 |
| 356213 | 878 | 101.2 | 80.5 | 109.9 |
| 356215 | 879 | 98.0 | 116.7 | 79.6 |
| 356216 | 880 | 102.8 | 84.7 | 113.2 |
| 356218 | 881 | 91.6 | 110.3 | 85.7 |
| 356221 | 882 | 106.8 | 74.0 | 81.2 |
| 356227 | 883 | 86.1 | 117.8 | 101.5 |
| 356229 | 884 | 109.7 | 100.3 | 97.5 |

From these data, it was observed that the oligomeric compound ISIS Number 327951 targeting the mature mir-15a miRNA blocked the inhibitory effect of mir-15a, exhibited as a recovery and increase in luciferase activity in HeLa cells expressing the pGL3-mir-15a sensor plasmid.

The pGL3-mir-23b sensor plasmid was created by cloning the sequence (GTGGTAATCCTGGCAATGTGAT; SEQ ID NO: 307), representing a sequence complementary to the mir-23b miRNA, into the Xba site of the pGL3-Control plasmid, placing the potential miRNA-binding site in the 3'UTR of the luciferase reporter. This reporter plasmid was used to transfect HeLa cells and it was observed that the endogenous mir-23b miRNA was able to inhibit luciferase expression from the pGL3-mir-23b sensor plasmid. Thus, to further evaluate the ability of the mir-23b miRNA to bind this target site endoced by the pGL3-mir-23b sensor plasmid, and to assess the ability of oligomeric compounds to interfere with mir-23b-mediated silencing, pGL3-mir-23b sensor-expressing HeLa cells were treated with varying concentrations (1.3-, 5- or 20 nM) of the following oligomeric compounds: ISIS Number 327889 (SEQ ID NO: 307), a phosphorothioate uniform 2'-MOE olgiomeric compound, and ISIS Number 340925 (SEQ ID NO: 307), a 2'-MOE 5-10-8 gapmer oligomeric compound, both targeting mir-23b. The uniform 2'-MOE phosphorothioate oligomeric compound ISIS Number 327924 (SEQ ID NO: 342) targeting an unrelated miRNA (mir-129-2) was used as a negative control. The data are the average of three trials, and are presented in Table 43 as relative luciferase activity (normalized to pRL-CMV luciferase plasmid only, not treated with oligomeric compound).

TABLE 43

Effects of oligomeric compounds on mir-23b miRNA-mediated inhibition of luciferase expression

| Treatment | SEQ ID NO | Fold change luciferase Dose of oligomeric compound | | |
|---|---|---|---|---|
| | | 1.3 nM | 5 nM | 20 nM |
| 327924 negative control | 342 | 1.15 | 0.68 | 0.92 |
| 327889-uniform MOE | 307 | 3.75 | 3.46 | 7.40 |
| 340925-gapmer | 307 | 0.99 | 1.41 | 1.19 |

From these data, it was observed that, at all doses, ISIS Number 327889, the uniform 2'-MOE oligomeric compound targeting the mature mir-23b miRNA, de-repressed the expression of the luciferase reporter. Thus, ISIS 327889 reversed the silencing effect of the mir-23b miRNA, apparently by inhibiting the binding of mir-23b to its target site encoded by the pGL3-mir-23b sensor plasmid.

The pGL3-mir-21 sensor plasmid was created by cloning the sequence (TCAACATCAGTCTGATAAGCTA; SEQ ID NO: 335), representing a sequence complementary to the mir-21 miRNA, into the Xba site of the pGL3-Control plasmid, placing the potential miRNA-binding site in the 3'UTR of the luciferase reporter. This reporter plasmid was used to transfect HeLa cells and it was observed that the endogenous mir-21 miRNA was able to inhibit luciferase expression from the pGL3-mir-21 sensor plasmid. Thus, to further evaluate the ability of the mir-21 miRNA to bind this target site encoded by the pGL3-mir-21 sensor plasmid, and to assess the ability of oligomeric compounds to interfere with mir-21-mediated silencing, pGL3-mir-21 sensor-expressing HeLa cells were treated with varying concentrations (10 nM or 50 nM) of the following oligomeric compounds: ISIS Number 327917 (SEQ ID NO: 335), a phosphorothioate uniform 2'-MOE oligomeric compound; ISIS Number 338697 (TGCCATGAGATTCAACAGTC; herein incorporated as SEQ ID NO: 524), a uniform 2'-MOE oligomeric compound targeting the mir-21 pri-miRNA molecule; and ISIS Number 328415 (SEQ ID NO: 524), a 2'-MOE 5-10-5 gapmer oligomeric compound targeting the mir-21 pri-miRNA. The uniform 2'-MOE phosphorothioate oligomeric compound ISIS Number 327901 (SEQ ID NO: 319) targeting an unrelated miRNA (mir-143) was used as a negative control. The data are the average of three trials and are presented in Table 44 as percent untreated control (luciferase plasmid only, not treated with oligomeric compound) luciferase expression, normalized to pRL-CMV levels.

TABLE 44

Effects of oligomeric compounds on mir-21 miRNA-mediated inhibition of luciferase expression

| Treatment | SEQ ID NO | % UTC Dose of oligomeric compound | |
|---|---|---|---|
| | | 10 nM | 50 nM |
| 327901 negative control | 319 | 74.2 | 83.1 |
| 327917 | 335 | 1037.6 | 847.5 |
| 338697 | 524 | 87.0 | 84.8 |
| 328415 | 524 | 66.0 | 104.4 |

From these data, it was observed that, at both doses, treatment of HeLa cells with ISIS Number 327917, the uniform 2'-MOE oligomeric compound targeting the mature mir-21 miRNA, de-repressed the expression of the luciferase reporter. Thus, ISIS 327917 reversed the silencing effect of the endogenous mir-21 miRNA, apparently by inhibiting the binding of mir-21 to its target site encoded by the pGL3-mir-21 sensor plasmid.

Therefore, oligomeric compounds targeting and/or mimicking the mir-143, mir-15a, mir-23b and mir-21 miRNAs and their corresponding pri-miRNA molecules have been demonstrated to bind to target RNA transcripts and silence reporter gene expression.

Example 28

Effects of Oligomeric Compounds on Expression of pri-miRNAs

As described above in Example 19, pri-miRNAs, often hundreds of nucleotides in length, are processed by a nuclear enzyme in the RNase III family known as Drosha, into approximately 70 nucleotide-long pre-miRNAs (also known as stem-loop structures, hairpins, pre-mirs or foldback miRNA precursors), and pre-miRNAs are subsequently exported from the nucleus to the cytoplasm, where they are processed by human Dicer into double-stranded miRNAs, which are subsequently processed by the Dicer RNase into mature miRNAs. It is believed that, in processing the pri-miRNA into the pre-miRNA, the Drosha enzyme cuts the pri-miRNA at the base of the mature miRNA, leaving a 2-nt 3'overhang (Lee, et al., Nature, 2003, 425, 415-419). The 3' two-nucleotide overhang structure, a signature of RNaseIII cleavage, has been identified as a critical specificity determinant in targeting and maintaining small RNAs in the RNA interference pathway (Murchison, et al., Curr. Opin. Cell Biol., 2004, 16, 223-9).

The oligomeric compounds of the present invention are believed to disrupt pri-miRNA and/or pre-miRNA structures, and sterically hinder Drosha and/or Dicer cleavage, respectively. Additionally, oligomeric compounds capable of binding to the mature miRNA are believed to prevent the RISC-mediated binding of a miRNA to its mRNA target, either by cleavage or steric occlusion of the miRNA.

Using the real-time RT-PCR methods described in Example 19, the expression levels of the mir-15a pri-miRNA were compared in HepG2 cells treated with a nested series of chimeric gapmer oligomeric compounds, targeting and spanning the entire length of the mir-15a pri-miRNA; these compounds are shown in Table 45, below. Each gapmer is 20 nucleotides in length, composed of a central "gap" region consisting of ten 2'-deoxynucleotides, which is flanked on both sides (5' and 3' directions) by five-nucleotide "wings." The wings are composed of 2'-methoxyethoxy (2'-MOE) nucleotides. The internucleoside (backbone) linkages are phosphorothioate (P=S) throughout the oligonucleotide. All cytidine residues are 5-methylcytidines. Using the transfection methods described herein, HepG2 cells were treated with 100 nM of each of these gapmer oligomeric compounds. Total RNA was isolated from HepG2 cells by lysing cells in 1 mL TRIZOL™ (Invitrogen) using the manufacturer's recommended protocols. Real-time RT-PCR analysis was performed using a primer/probe set specific for the mir-15a pri-miRNA molecule to assess the effects of these compounds on expression of the mir-15a pri-miRNA molecule. ISIS 339317 (GTGTGTTTAAAAAAAATAAAACCT-TGGA; SEQ ID NO.: 885) was used as the forward primer, ISIS 339318 (TGGCCTGCACCTTTTCAAA; SEQ ID NO.: 886) was used as the reverse primer, and ISIS 339319 (AAAGTAGCAGCACATAATGGTTTGTGG; SEQ ID NO.: 887) was used as the probe. Total RNA was quantified using RiboGreen™ RNA quantification reagent (Molecular Probes, Inc. Eugene, Oreg.), expression levels observed for each target are normalized to 5.8S rRNA, and values are expressed relative to the untreated control. Inhibition of expression of the mir15a pri-miRNA by these gapmer oligomeric compounds is expressed as a percentage of RNA levels in untreated control cells.

Results of These Experiments are Described in Table 45 Below:

TABLE 45

Effects of chimeric oligomeric compounds on expression of the mir-15a pri-miRNA

| ISIS Number | SEQ ID NO | Sequence | Expression of mir-15a pri-miRNA (% UTC) |
|---|---|---|---|
| 347964 | 878 | TATAACATTGATGTAATATG | 13.7 |
| 347965 | 888 | GCTACTTTACTCCAAGGTTT | 86.0 |
| 347966 | 879 | TGCTACTTTACTCCAAGGTT | 39.2 |
| 347967 | 880 | GCACCTTTTCAAAATGCACA | 152.3 |
| 347968 | 889 | CCTGCACCTTTTCAAAATCC | 8.4 |
| 347969 | 881 | TGGCCTGCACCTTTTCAAAA | 39.5 |
| 347970 | 890 | ATATGGCCTGCACCTTTTCA | 2.2 |
| 347971 | 891 | ACAATATGGCCTGCACCTTT | 92.8 |
| 347972 | 882 | AGCACAATATGGCCTGCACC | 98.6 |
| 347973 | 892 | GGCAGCACAATATGGCCTGC | 143.3 |
| 347974 | 893 | TGAGGCAGCACAATATGGCC | 98.1 |
| 347975 | 894 | TTTTGAGGCAGCACAATATG | 9.2 |
| 347976 | 895 | TATTTTGAGGCAGCACAAT | 73.0 |
| 347977 | 896 | TTGTATTTTGAGGCAGCAC | 111.3 |
| 347978 | 883 | TCCTTGTATTTTGAGGCAG | 51.1 |
| 347979 | 897 | AGATCCTTGTATTTTGAGG | 74.9 |
| 347980 | 884 | AGATCAGATCCTTGTATTTT | 3.6 |

TABLE 45-continued

Effects of chimeric oligomeric compounds on expression of the mir-15a pri-miRNA

| ISIS Number | SEQ ID NO | Sequence | Expression of mir-15a pri-miRNA (% UTC) |
|---|---|---|---|
| 347981 | 898 | AGAAGATCAGATCCTTGTAT | N/D |
| 347982 | 899 | TTCAGAAGATCAGATCCTTG | 82.2 |
| 347983 | 900 | AAATATATTTTCTTCAGAAG | 13.0 |

From these data, it was observed that oligomeric compounds ISIS Numbers 347964, 347966, 347968, 347970, 347975, 347980 and 347983 show significant inhibition of expression of the mir-15a pri-miRNA molecule. Thus, it is believed that the antisense oligomeric compounds ISIS Numbers 347964, 347966, 347968, 347970, 347975, 347980 and 347983 bind to the mir-15a pri-miRNA and/or pre-miRNA molecules and cause their degradation and cleavage.

From these data, it was observed that oligomeric compounds ISIS Numbers 347967, 347977 and 347973 stimulate an increase in expression levels of the mir-15a pri-miRNA. It is believed that the oligomeric compounds ISIS Numbers 347967, 347977 and 347973 bind to the mir-15a pri-miRNA and inhibit its processing into the mature mir-15a miRNA. It is believed that, in addition to the increase in the levels of the mir-15a pri-miRNA observed upon treatment of cells with the oligomeric compounds ISIS Numbers 347977, 347967 and 347973, a drop in expression levels of the fully processed mature mir-15a miRNA may also trigger a feedback mechanism signaling these cells to increase production of the mir-15a pri-miRNA.

The gapmer oligomeric compounds targeting the mir-15b and mir-15-a-1 mature miRNAs described above were also transfected into T47D cells according to standard procedures. In addition, uniform 2'-MOE and 2'-MOE gapmer oligomeric compounds targeting the mature mir-15a- 1 and mir-15b miRNAs were also transfected into T47D cells, for analysis of their effects on mir-15a-1 and mir-15b pri-miRNA levels. The oligomeric compounds ISIS Number 327927 (SEQ ID NO: 345), a uniform 2'-MOE compound and ISIS Number 345391 (SEQ ID NO: 345), a 2'-MOE 5-10-7 gapmer compound, both target mir-15b. The oligomeric compounds ISIS Number 327951 (SEQ ID NO: 369), a uniform 2'-MOE compound, and ISIS Number 345411 (SEQ ID NO: 369), a 2'-MOE 5-10-7 gapmer compound, both target mir-15a-1. Oligomeric compounds ISIS Number 129686 (CGTTAT-TAACCTCCGTTGAA; SEQ ID NO: 901), and ISIS Number 129691 (ATGCATACTACGAAAGGCCG; SEQ ID NO:902), both universal scrambled controls, as well as ISIS Number 116847 (CTGCTAGCCTCTGGATTTGA; SEQ ID NO: 844) targeting an unrelated gene, PTEN, were used as negative controls. ISIS Numbers 129686, 129691, and 116847 are phosphorothiated 2'-MOE 5-10-5 gapmers, and all cytosines are 5-methylcytosines. T47D cells (seeded in 12-well plates) were treated with these oligomeric compounds, and RNA was isolated from the treated cells by lysing in 1 mL TRIZOL™ (Invitrogen) and total RNA was prepared using the manufacturer's recommended protocols. To assess the effects of these compounds on expression of the mir-15a or mir-15b pri-miRNA molecules, real-time RT-PCR analysis was performed using either the primer/probe set specific for the mir-15a pri-miRNA molecule described above, or a primer probe set specific for the mir-15b pri-miRNA molecule: ISIS 339320 (CCTACATTTTTGAGGCCTTAAAG- TACTG; SEQ ID NO: 903) was used as the forward primer for the mir-15b pri-miRNA, ISIS 339321 (CAAATAATGAT-TCGCATCTTG ACTGT; SEQ ID NO: 904) was used as the reverse primer for the mir-15b pri-miRNA, and ISIS 339322 (AGCAGCACATCATGGTTTACATGC; SEQ ID NO: 905) was used as the probe. Total RNA was quantified using RiboGreen™ RNA quantification reagent (Molecular Probes, Inc. Eugene, Oreg.), expression levels observed for each target were normalized to 5.8S rRNA, and values are expressed relative to the untreated control. Inhibition of expression of the mir15a or mir-15b pri-miRNA molecules upon treatment with these oligomeric compounds is was assessed and expressed as a percentage of RNA levels in untreated control cells.

On multiple repeats of these experiments, it was observed that the uniform 2'-MOE oligomeric compounds ISIS Number 327927 (SEQ ID NO: 345) and ISIS Number 327951 (SEQ ID NO: 369), targeted to the mature mir-15b and mir-15a-1 miRNAs, respectively, each stimulate and approximately 2.5- to 3.5-fold increase in expression of the mir-15a pri-miRNA molecule and an approximately 1.5- to 2.5-fold increase in the expression of the mir-15b pri-mRNA molecule. Therefore, it is believed that ISIS Numbers 327927 and 327951 can bind to the mir-15a and/or mir-15b pri-miRNA or pre-miRNA molecules and interfere with their processing into the mature mir-5a or mir-15b miRNAs. It is also recognized that a decrease in levels of the mature, processed forms of the mir-15a or mir-15b miRNAs in T47D cells treated with ISIS Number 345411 (SEQ ID NO: 369), ISIS Number 327927 (SEQ ID NO: 345) or ISIS Number 327951 (SEQ ID NO: 369) may also trigger a feedback mechanism that signals these cells to increase production of the mir-15a and/or mir-15b pri-miRNA molecules.

In accordance with the present invention, a nested series of uniform 2'-MOE oligomeric compounds were designed and synthesized to target the entire length of the mir-15a pri-miRNA molecule. Each compound is 19 nucleotides in length, composed of 2'-methoxyethoxy (2'-MOE) nucleotides and phosphorothioate (P=S) internucleoside linkages throughout the oligonucleotide. All cytidine residues are 5-methylcytidines. The compounds are shown in Table 46. The compounds can be analyzed for their effect on mature miRNA, pre-miRNA or pri-miRNA levels by quantitative real-time PCR, or they can be used in other assays to investigate the role of miRNAs or the function of targets downstream of miRNAs.

TABLE 46

Uniform 2'-MOE PS Compounds targeting the mir-15a pri-miRNA

| ISIS Number | SEQ ID NO | Sequence |
|---|---|---|
| 356213 | 878 | TATAACATTGATGTAATATG |
| 356214 | 879 | GCTACTTTACTCCAAGGTTT |
| 356215 | 880 | TGCTACTTTACTCCAAGGTT |
| 356216 | 881 | GCACCTTTTCAAAATCCACA |
| 356217 | 882 | CCTGCACCTTTTCAAAATCC |
| 356218 | 883 | TGGCCTGCACCTTTTCAAAA |
| 356219 | 884 | ATATGGCCTGCACCTTTTCA |
| 356220 | 888 | ACAATATGGCCTGCACCTTT |

TABLE 46-continued

Uniform 2'-MOE PS Compounds targeting the mir-15a pri-miRNA

| ISIS Number | SEQ ID NO | Sequence |
|---|---|---|
| 356221 | 889 | AGCACAATATGGCCTGCACC |
| 356222 | 890 | GGCAGCACAATATGGCCTGC |
| 356223 | 891 | TGAGGCAGCACAATATGGCC |
| 356224 | 892 | TTTTGAGGCAGCACAATATG |
| 356225 | 893 | TATTTTTGAGGCAGCACAAT |
| 356226 | 894 | TTGTATTTTTGAGGCAGCAC |
| 356227 | 895 | TCCTTGTATTTTTGAGGCAG |
| 356228 | 896 | AGATCCTTGTATTTTTGAGG |
| 356229 | 897 | AGATCAGATCCTTGTATTTT |
| 356230 | 898 | AGAAGATCAGATGCTTGTAT |
| 356231 | 899 | TTCAGAAGATCAGATCCTTG |
| 356232 | 900 | AAATATATTTTCTTCAGAAG |

Using the real-time RT-PCR methods described, the expression levels of the mir-15a pri-miRNA were compared in T47D cells treated with the nested series of uniform 2'-MOE oligomeric compounds, targeting and spanning the entire length of the mir-15a pri-miRNA. The region encompassing the mir-15a primary transcript (the complement of nucleotides 31603159 to 31603468 of GenBank Accession number NT_024524.13; AAATAATTATGCATATTACAT-CAATGTTATAATGTTTAAACATAGATTTTTTTACATG CATTCTTTTTTTCCTGAAAGAAAATATTTTTTATATT CTTTAGGCGCGAATGTGTGTTTAAAAAAAATAAAA CCTTGGAGTAAAGTAGCAGCACATAATGGTTTGTG GATTTTGAAAA GGTGCAGGCCATATTGTGCTGCCT-CAAAAATACAAGGATCTGATCTTCTGAAGAAAATAT ATTTCTTTTTATTCATAGCTCTTATGATAGCAATGTC AGCAGTGCCTTAGCAGCACGTAAATATTGGCGTT AAG) is incorporated herein as SEQ ID NO: 906. ISIS Number 356215 (SEQ ID NO: 879) targets a region flanking and immediately 5' to the predicted 5' Drosha cleavage site in the mir-15a pri-miRNA. ISIS Number 356218 (SEQ ID NO: 881) targets a region in the loop of the mir-15a pri-miRNA. ISIS 356227 (SEQ ID NO: 883) targets a region flanking and immediately 3' to the predicted 3' Drosha cleavage site in the mir-15a pri-miRNA. Additionally, oligomeric compound ISIS 327951 (SEQ ID NO: 369), a uniform 2'-MOE compound targeting the mature mir-15a-1 miRNA, was tested for comparison. Oligomeric compounds ISIS 327901 (SEQ ID NO: 319) targeting the mature mir-143 miRNA; ISIS 129690, (TTAGAATACGTCGCGTTATG; SEQ ID NO: 907), a phosphorothioate 5-10-5 MOE gapmer used as a universal scrambled control; and ISIS 116847 (CTGCTAGCCTCTG-GATTTGA; SEQ ID NO: 844), a uniform 5-10-5 2'-MOE gapmer targeting an unrelated gene, PTEN, were used as negative controls. Using the transfection methods previously described, T47D cells were treated with 100 nM of each of these oligomeric compounds. Total RNA was isolated by lysing cells in 1 mL TRIZOL™ (Invitrogen) using the manufacturer's recommended protocols. Real-time RT-PCR analysis was performed using a primer/probe set specific for the mir-15a pri-miRNA molecule [forward primer=ISIS 339317 (SEQ ID NO.: 885), reverse primer=ISIS 339318 (SEQ ID NO.: 886), and probe=ISIS 339319 (SEQ ID NO.: 887)]. Total RNA was quantified using RiboGreen™ RNA quantification reagent (Molecular Probes, Inc. Eugene, Oreg.), expression levels observed for each target were normalized to 5.8S rRNA, and values were expressed relative to the untreated control (UTC). Effects on expression of the mir-15a pri-miRNA molecule resulting from treatment of T47D cells with these uniform 2'-MOE oligomeric compounds is expressed as a percentage of RNA levels in untreated control cells. Results of these experiments are described in Table 47 below:

TABLE 47

Effects of uniform 2'-MOE oligomeric compounds on mir-15a pri-miRNA expression

| ISIS # | SEQ ID NO: | target | % UTC |
|---|---|---|---|
| UTC | N/A | N/A | 100 |
| 129690 scrambled control | XXX | N/A | 121 |
| 327901 | 319 | mir-143 | 132 |
| 116847 | 844 | PTEN mRNA | 132 |
| 327951 | 369 | mature mir-15a-1 | 713 |
| 356213 | 878 | >100 bp upstream of mature mir-15a | 171 |
| 356215 | 879 | flanking 5' Drosha cleavage site of mir-15a-1 pri-miRNA | 1005 |
| 356216 | 880 | mir-15a-1 pri-miRNA | 503 |
| 356218 | 881 | loop of mir-15a-1 pri-miRNA | 392 |
| 356221 | 882 | mir-15a-1 pri-miRNA | 444 |
| 356224 | 894 | mir-15a-1 pri-miRNA | 592 |
| 356227 | 883 | flanking 3' Drosha cleavage site of mir-15a-1 pri-miRNA | 879 |
| 356229 | 884 | mir-15a-1 pri-miRNA | 818 |
| 356231 | 899 | mir-15a-1 pri-miRNA | 811 |
| 356232 | 900 | mir-15a-1 pri-miRNA | 631 |

From these data, it was observed that the uniform 2'-MOE oligomeric compounds ISIS Numbers 327927, 327951, 356215, 356216, 356218, 356221, 356224, 356227, 356229, 356231 and 356232 stimulate an increase in levels of the mir-15a pri-miRNA molecule as detected by real-time RT-PCR. Notably, oligomeric compounds ISIS Numbers 356215 and 356277 which target the regions immediately flanking the predicted 5' and 3' Drosha cleavage sites in the mir-15a pri-miRNA, respectively, were observed to stimulate the greatest increases in expression of the mir-15a pri-miRNA. It is believed that these oligomeric compounds bind to the mir-15a pri-miRNA and/or pre-miRNA molecules and interfere with their processing into the mature mir-15a miRNA, possibly by interfering with the activity of RNase III-like enzymes such as human Dicer and/or Drosha. The resultant decrease in levels of the processed mature mir-15a miRNA may trigger a feedback mechanism leading to an upregulation of production of the mir-15a pri-miRNA molecule. Not mutually exclusive with the processing interference and the feedback mechanisms is the possibility that treatment with oligomeric compounds could stimulate the activity of an RNA-dependent RNA polymerase (RdRP) that amplifies the mir-15a pri-miRNA or pre-miRNA molecules. It is understood that such oligomeric compound-triggered mechanisms may be operating not only upon regulation of mir-15a production and processing, but may also be found to regulate the production and processing of other miRNAs.

The expression levels of mir-24-2, let-7i, and let-7d were assessed in HeLa or T-24 cells treated with various uniform 2'-MOE oligomeric compounds targeting mature miRNAs. For example, using the transfection methods previously described, HeLa cells were treated with 100 nM of the oligomeric compound ISIS Number 327945 (SEQ ID NO: 363) targeting the mir-24-2 mature miRNA. Total RNA was isolated and expression levels of the mir-24-2 pri-miRNA were analyzed by real-time quantitative RT-PCR using a primer/probe set specific for the mir-24-2 pri-miRNA molecule [forward primer=ISIS 359358 (CCCTGGGCTCTGCCT; herein incorporated as SEQ ID NO.: 908), reverse primer=ISIS 359359 (TGTACACAAACCAACTGTGTTTC; herein incorporated as SEQ ID NO.: 909), and probe=ISIS 359360 (CGTGCCTACTGAGC; herein incorporated as SEQ ID NO.: 910)]. An approximately 35-fold increase in expression levels of the mir-24-2 pri-miRNA molecule was observed in HeLa cells treated with the oligomeric compound ISIS 327945 as detected by real-time RT-PCR.

Using the transfection methods previously described, HeLa cells were treated with 100 nM of the oligomeric compound ISIS Number 327890 (SEQ ID NO: 308) targeting the let-7i mature miRNA. Total RNA was isolated and expression levels of the let-7i pri-miRNA were analyzed by real-time quantitative RT-PCR using a primer/probe set specific for the let-7i pri-miRNA molecule [forward primer=ISIS 341684 (TGAGGTAGTAGTTTGTGCTGTTGGT; herein incorporated as SEQ ID NO.: 777), reverse primer=ISIS 341685 (AGGCAGTAGCTTGCGCAGTTA; herein incorporated as SEQ ID NO.: 778), and probe=ISIS 341686 (TTGTGACATTGCCCGCTGTGGAG; herein incorporated as SEQ ID NO.: 779)]. An approximately 4-fold increase in expression levels of the let-7i pri-miRNA molecule was observed in HeLa cells treated with the oligomeric compound ISIS 327890 as detected by real-time RT-PCR.

Using the transfection methods previously described, supra, T-24 cells were treated with 100 nM of the oligomeric compound ISIS Number 327926 (SEQ ID NO: 344) targeting the let-7d mature miRNA. Total RNA was isolated and expression levels of the let-7d pri-miRNA were analyzed by real-time quantitative RT-PCR using a primer/probe set specific for the let-7d pri-miRNA molecule (forward primer=ISIS 341678 (CCTAGGAAGAGGTAG TAGGTTGCA; herein incorporated as SEQ ID NO.: 771), reverse primer=ISIS 341679 (CAGCAGGTCGTATAGTTACCTCCTT; herein incorporated as SEQ ID NO.: 772), and probe=ISIS 341680 (AGTTTTAGGGCAGGGATTTTGCCCA; herein incorporated as SEQ ID NO.: 773)). An approximately 1.7-fold increase in expression levels of the let-7d pri-miRNA molecule was observed in T-24 cells treated with the oligomeric compound ISIS 327926 as detected by real-time RT-PCR.

Thus, treatment with uniform 2'-MOE oligomeric compounds targeting mature miRNAs appears to result in an induction of expression of the corresponding pri-miRNA molecule.

In one embodiment, the expression of mir-21 (noted to be expressed at high levels in HeLa cells) was assessed in cells treated with oligomeric compounds. Using the transfection methods previously described, HeLa cells were treated with 100 nM of the uniform 2'-MOE oligomeric compound ISIS Number 327917 (SEQ ID NO: 335) targeting the mir-21 mature miRNA. Total RNA was isolated by lysing cells in 1 mL TRIZOL™ (Invitrogen) using the manufacturer's recommended protocols. By Northern blot analysis of total RNA from HeLa cells treated with ISIS 327917, expression levels of the mir-21 mature miRNA were observed to be reduced to 50% of those of untreated control cells. Furthermore, expression levels of the mir-21 pri-miRNA were found to increase in these HeLa cells treated with the oligomeric compound ISIS 327917. Real-time RT-PCR analysis was also performed on HeLa cells treated with ISIS 327917 using a primer/probe set specific for the mir-21 pri-miRNA molecule [forward primer=ISIS 339332 (GCTGTACCACCTTGTCGGGT; herein incorporated as SEQ ID NO.: 911), reverse primer=ISIS 339333 (TCGACTGGTGTTGCCATGA; herein incorporated as SEQ ID NO.: 912), and probe=ISIS 339334 (CTTATCAGACTGATGTTGACTGTTGAAT; herein incorporated as SEQ ID NO.: 913)]. Total RNA was quantified using RiboGreen™ RNA quantification reagent (Molecular Probes, Inc. Eugene, Oreg.), expression levels observed for the target were normalized to 5.8S rRNA, and values were expressed relative to an untreated control (UTC). ISIS Number 327917 was observed to stimulate an approximately 2-fold increase in levels of the mir-21 pri-miRNA molecule as detected by real-time RT-PCR.

Thus, it is believed that, in addition to binding the mir-21 mature miRNA and interfering with the RISC-mediated binding of mir-21 to its mRNA target, the oligomeric compound, ISIS 327917, binds to the mir-21 pri-miRNA and/or pre-miRNA molecules and interferes with their processing into the mature mir-21 miRNA, inhibiting expression of the mature mir-21 miRNA in HeLa cells, possibly by interfering with the activity of RNase III-like enzymes such as human Dicer or Drosha. The resultant decrease in levels of mature mir-21 miRNA may trigger a feedback mechanism leading to an upregulation of production of the mir-21 pri-miRNA molecule. Treatment with this oligomeric compound could also stimulate the activity of an RNA-dependent RNA polymerase (RdRP) that amplifies the mir-21 pri-miRNA or pre-miRNA molecules.

In accordance with the present invention, a nested series of uniform 2'-MOE oligomeric compounds were designed and synthesized to target the entire length of the mir-21 pri-miRNA molecule. The region encompassing the mir-21 primary transcript nucleotides 16571584 to 16571864 of GenBank Accession number NT_010783.14; CTGGGTTTTTTTG-GTTTGTTTTTGTTTTTGTTTTTTTAT-CAAATCCTGCCTGACTGT CTGCTTGTTTTGCCTAC-CATCGTGACATCTCCATGGCTGTACCACCTTGTCGGGTA GCTTATCAGACTGATGTTGACTGT-TGAATCTCATGGCAACACCAGTCGATGGGCT GTCT-GACATTTTGGTATCTTTCATCTGAC-CATCCATATCCAATGTTCTCATTTAA CATTACCCAGCATCATTGTTTATAATCA-GAAACTCTGGTCCTTCTGTCTGGTGGCA C) is incorporated herein as SEQ ID NO: 914. Each compound is 20 nucleotides in length, composed of 2'-methocyethoxy (2'-MOE) nucleotides and phosphorothioate (P=S) internucleoside linkages throughout the compound. All cytidine residues are 5-methylcytidines. The compounds are shown in Table 48. The compounds can be analyzed for their effect on mature miRNA, pre-miRNA or pri-miRNA levels by quantitative real-time PCR, or they can be used in other assays to investigate the role of miRNAs or the function of targets downstream of miRNAs.

TABLE 48

Uniform 2'-MOE PS Compounds targeting the mir-21 pri-miRNA

| ISIS Number | SEQ ID NO | Sequence |
|---|---|---|
| 358765 | 915 | ACAAGCAGACAGTCAGGCAG |
| 358766 | 916 | GGTAGGCAAAACAAGCAGAC |
| 358767 | 917 | GGAGATGTCACGATGGTAGG |
| 358768 | 918 | AGGTGGTACAGCCATGGAGA |
| 358769 | 919 | GATAAGCTACCCGACAAGGT |
| 358770 | 920 | AGTCTGATAAGCTACCCGAC |
| 358771 | 921 | CAACAGTCAACATCAGTCTG |
| 358772 | 922 | GAGATTCAACAGTCAACATC |
| 358773 | 923 | CTGGTGTTGCCATGAGATTC |
| 358774 | 924 | CATCGACTGGTGTTGCCATG |
| 358775 | 925 | ACAGCCCATCGACTGGTGTT |
| 358776 | 926 | TGTCAGACAGCCCATCGACT |
| 358777 | 927 | CCAAAATGTCAGACAGCCCA |
| 358778 | 928 | GATACCAAAATGTCAGACAG |
| 358779 | 929 | GGTCAGATGAAAGATACCAA |
| 358780 | 930 | AACATTGGATATGGATGGTC |
| 358781 | 931 | TAATGTTTAAATGAGAACAT |
| 358782 | 932 | AACAATGATGCTGGGTAATG |
| 358783 | 933 | GAGTTTCTGATTATAAACAA |
| 358784 | 934 | CGACAAGGTGGTACAGCCAT |
| 358785 | 935 | GAAAGATACCAAAATGTCAG |

Using the real-time RT-PCR methods, the expression levels of the mir-21 pri-miRNA were compared in HeLa cells treated with this nested series of uniform 2'-MOE oligomeric compounds, targeting and spanning the entire length of the mir-21 pri-miRNA. ISIS Number 358768 (SEQ ID NO: 918) targets a region flanking the predicted 5' Drosha cleavage site in the mir-21 pri-miRNA. ISIS Number 358777 (SEQ ID NO: 927) targets a region spanning the 3' Drosha cleavage site in the mir-21 pri-miRNA. ISIS 358779 (SEQ ID NO: 929) targets a region flanking the predicted 3+'Drosha cleavage site in the mir-21 pri-miRNA. Additionally, oligomeric compounds ISIS 327917 (SEQ ID NO: 335), a uniform 2'-MOE compound targeting the mature mir-21 miRNA, and ISIS 345382 (TCAACATCAGTCTGATAAGCTA; SEQ ID NO: 335), a 5-10-7 phosphorothioate 2'-MOE gapmer targeting mir-21, were tested for comparison. Oligomeric compound ISIS 327863 (ACGCTAGCCTAATAGCGAGG; herein incorporated as SEQ ID NO: 936), a phosphorothioate 5-10-5 2'-MOE gapmer, was used as scrambled control. Using the transfection methods previously described, HeLa cells were treated with 100 nM of each of these oligomeric compounds. Total RNA was isolated by lysing cells in 1 mL TRIZOL™ (Invitrogen) using the manufacturer's recommended protocols. Real-time RT-PCR analysis was performed using the primer/probe set specific for the mir-21 pri-miRNA molecule

[forward primer=ISIS 339332 (SEQ ID NO.: 911), reverse primer=ISIS 339333 (SEQ ID NO.: 912), and probe=ISIS 339334 (SEQ ID NO.: 913)]. Total RNA was quantified using RiboGreen™ RNA quantification reagent (Molecular Probes, Inc. Eugene, Oreg.), expression levels observed for each target were normalized to 5.8S rRNA, and values were expressed relative to the untreated control (UTC). Effects on expression of the mir-21 pri-miRNA molecule resulting from treatment of HeLa cells with these uniform 2'-MOE oligomeric compounds is expressed as a percentage of RNA levels in untreated control cells. Results of these experiments are shown in Table 49 below:

TABLE 49

Effects of oligomeric compounds on mir-21 pri-miRNA expression

| ISIS # | SEQ ID NO: | target | % UTC |
|---|---|---|---|
| UTC | N/A | N/A | 100 |
| 327863 gapmer control | 936 | N/A | 107 |
| 327917 uniform 2'-MOE | 335 | mature mir-21 | 249 |
| 345382 5-10-7 2'-MOE gapmer | 335 | mature mir-21 | 119 |
| 358765 | 915 | mir-21 pri-miRNA | 133 |
| 358766 | 916 | mir-21 pri-miRNA | 142 |
| 358767 | 917 | mir-21 pri-miRNA | 248 |
| 358768 | 918 | flanking 5' Drosha cleavage site of mir-21 pri-miRNA | 987 |
| 358769 | 919 | mir-21 pri-miRNA | 265 |
| 358770 | 920 | mir-21 pri-miRNA | 250 |
| 358771 | 921 | mir-21 pri-miRNA | 181 |
| 358772 | 922 | mir-21 pri-miRNA | 245 |
| 358773 | 923 | mir-21 pri-miRNA | 148 |
| 358774 | 924 | mir-21 pri-miRNA | 104 |
| 358775 | 925 | mir-21 pri-miRNA | 222 |
| 358776 | 926 | mir-21 pri-miRNA | 367 |
| 358777 | 927 | spanning 3' Drosha cleavage site of mir-21 pri-miRNA | 536 |
| 358778 | 928 | mir-21 pri-miRNA | 503 |
| 358779 | 929 | flanking 3' Drosha cleavage site of mir-21 pri-miRNA | 646 |
| 358780 | 930 | mir-21 pri-miRNA | 269 |
| 358781 | 931 | mir-21 pri-miRNA | 122 |
| 358782 | 932 | mir-21 pri-miRNA | 155 |
| 358783 | 933 | mir-21 pri-miRNA | 133 |
| 358784 | 934 | mir-21 pri-miRNA | 358 |
| 358785 | 935 | mir-21 pri-miRNA | 257 |

From these data, it was observed that the uniform 2'-MOE oligomeric compounds ISIS Numbers 327917, 358767, 358768, 358769, 358770, 358772, 358775, 358776, 358777, 358778, 358779, 358780, 358784 and 358785 stimulate an increase in levels of the mir-21 pri-miRNA molecule as detected by real-time RT-PCR. Notably, oligomeric compounds ISIS Numbers 358768 and 358779 which target the regions flanking the predicted 5' and 3' Drosha cleavage sites, respectively, and ISIS Number 358777, which targets a region spanning the 3'Drosha cleavage site in the mir-21 pri-miRNA were observed to stimulate the greatest increases in expression of the mir-21 pri-miRNA. Furthermore, treatment of HeLa cells with increasing concentrations (25, 50, 100, and 200 nM) of ISIS Numbers 358768, 358779, and 327917 was observed to result in a dose-responsive induction of mir-21 pri-miRNA levels. Thus, it is believed that these oligomeric compounds bind to the mir-21 pri-miRNA and/or pre-miRNA molecules and interfere with their processing into the mature mir-21 miRNA, possibly by interfering with the activity of RNase III-like enzymes such as human Dicer and/or Drosha. The resultant decrease in levels of the processed mature mir-21 miRNA may trigger a feedback mechanism leading to an upregulation of production of the mir-21 pri-miRNA molecule. Not mutually exclusive with the processing interference and the feedback mechanisms is the possibility that treatment with oligomeric compounds could stimulate the activity of an RNA-dependent RNA polymerase (RdRP) that amplifies the mir-21 pri-miRNA or pre-miRNA molecules. It is understood that such oligomeric compound-triggered mechanisms may be operating not only upon regulation of mir-21 production and processing, but may also be found to regulate the production and processing of other miRNAs or target nucleic acids.

In one embodiment, the oligomeric compounds ISIS Number 327917 (SEQ ID NO: 335), the phosphorothioate uniform 2'-MOE targeting mature mir-21; ISIS Number 358768 (SEQ ID NO: 918), the uniform 2'-MOE targeting the mir-21 pri-miRNA which stimulated the largest increase in pri-miRNA expression levels by real time quantitative RT-PCR; and ISIS Number 345382 (SEQ ID NO: 335), the 5-10-7 phosphorothioate 2'-MOE gapmer targeting mature mir-21 were selected for dose response studies in HeLa cells using the luciferase reporter system described in Example 27. ISIS Number 342683 (SEQ ID NO: 790), representing the scrambled nucleotide sequence of an unrelated PTP 1B antisense oligonucleotide, was used as a negative control. HeLa cells expressing the pGL3-mir-21 sensor plasmid (described in Example 27) were treated with 1.9, 5.5, 16.7, and 50 nM of these oligomeric compounds, to assess the ability of oligomeric compounds to interfere with endogenous mir-21-mediated silencing of the pGL3-mir-21 sensor plasmid. The data are presented in Table 50 as percent untreated control (luciferase plasmid only, not treated with oligomeric compound) luciferase expression, normalized to pRL-CMV levels.

TABLE 50

Effects of oligomeric compounds on mir-21 miRNA-mediated inhibition of luciferase expression

| | % UTC Dose of oligomeric compound | | | |
|---|---|---|---|---|
| Treatment | 1.9 nM | 5.5 nM | 16.7 nM | 50 nM |
| 342683 negative control | 127 | 171 | 104 | 108 |
| 327917 | 522 | 1293 | 2470 | 4534 |
| 358768 | 103 | 163 | 146 | 118 |
| 345382 | 101 | 135 | 117 | 95 |

From these data, it was observed that, at all doses, treatment of HeLa cells with ISIS Number 327917, the uniform 2'-MOE oligomeric compound targeting the mature mir-21 miRNA, de-repressed the expression of the luciferase reporter, in a dose-dependent fashion. Thus, ISIS 327917 reversed the silencing effect of the endogenous mir-21 miRNA, possibly by inhibiting the binding of mir-21 to its target site encoded by the pGL3-mir-21 sensor plasmid.

Example 29

Diseases Associated with miRNA-Containing Loci

Using the public databases Online Mendelian Inheritance in Man (OMIM) (accessible through the Internet at, for example, ftp.ncbi.nih.gov/repository/OMIM/) and Locus-Link (accessible at, for example, ftp.ncbi.nlm.nih.gov/refseq/LocusLink/), a bioinformatic analysis was performed which allowed the prediction of miRNAs associated with several human diseases. First, miRNAs encoded within genes having LocusLink identification numbers were identified, and these were compared to tables (for example, "mim2loc," which connects LocusLink identification numbers with OMIM identification numbers, as well as "genemap," "genemap.key," "mim-title," and "morbidmap" tables) for the construction of a new database called "db1.mdb" linking miRNAs to LocusLink and OMIM identification numbers and linking these to human diseases.

It was observed that, beginning with 95 pri-miRNAs, a subset of 49 had OMIM identification numbers, 48 of which were linked to OMIM names. Six of these miRNAs were associated with specific diseased patients (some in each category were duplicates). Thus, the majority of miRNAs with OMIM identification numbers are not directly linked to observed diseases, but are likely to be important in pathways (such as cholesterol homeostasis) associated with diseases. Tables 51 and 52 summarize information retrieved from these studies.

TABLE 51 miRNA genes associated with specific diseases

| OMIM ID: | locus containing miRNA | Disease association: |
|---|---|---|
| 120150 | collagen, type I, alpha 1/ hypothetical miRNA-144 | Osteogenesis imperfecta, type I, 166200 |
| 114131 | calcitonin receptor containing hypothetical miRNA 30 | Osteoporosis, postmenopausal susceptibility, 166710 |
| 605317 | forkhead box P2/ hypothetical miRNA 169 | Speech-language disorder-1, 602081 |
| 600700 | LIM domain-containing preferred translocation partner in lipoma containing miR-28 | Lipoma; Leukemia, myeloid |
| 160710 | myosin, heavy polypeptide 6, cardiac muscle, alpha (cardiomyopathy, hypertrophic 1) containing miR-208 | Cardiomyopathy, familial hypertrophic, 192600 |
| 606157 | hypothetical protein FLJ11729 containing mir-103-2 | Neurodegeneration, pantothenate kinase-associated, 234200 |

The previous table shows miRNAs associated with an OMIM record that were also associated with diseased patients.

The following table, Table 52, describes diseases or disease-related phenotypes found to be associated with genetic loci associated with a miRNA.

TABLE 52 miRNAs associated with disease phenotypes

| OMIM ID: | Locus containing miRNA | Disease association: |
|---|---|---|
| 114131 | calcitonin receptor containing hypothetical miRNA-30 | Osteoporosis, postmenopausal, susceptibility, 166710 |
| 120150 | collagen, type I, alpha 1/ hypothetical miRNA-144 | Osteogenesis imperfecta, type I, 166200 |
| 138247 | glutamate receptor, ionotropic, AMPA 2/hypothetical miRNA-171 | cerebellar long-term depression |
| 160710 | myosin, heavy polypeptide 6, cardiac muscle, alpha (cardiomyopathy, hypertrophic 1) containing miR-208 | Cardiomyopathy, familial hypertrophic, 192600 |
| 184756 | sterol regulatory element-binding protein-1/mir-33b | Emery-Dreifuss muscular dystrophy, 310300; dilated cardiomyopathy (CMD1A), 115200; familial partial lipodystrophy (FPLD), 151660 |
| 300093 | gamma-aminobutyric acid (GABA) A receptor, epsilon | early-onset parkinsonism, or Waisman syndrome, 311510; and MRX3 X-linked mental retardation, 309541 |
| 305660 | gamma-aminobutyric acid (GABA) A receptor, alpha 3 containing miR-105 (Mourelatos) and miR-105-2 | manic depressive illness, colorblindness, and G6PD |
| 305915 | glutamate receptor, ionotropic, AMPA 3/hypothetical miRNA-033 | complex bipolar disorder; drug addiction |
| 600150 | potassium large conductance calcium-activated channel, subfamily M, alpha member 1 containing hypothetical miRNA-172 | cardiovascular disease |
| 600395 | glypican 1 containing miR-149 | angiogenesis |
| 600481 | Sterol regulatory element binding transcription factor 2 containing mir-33a | LDL and cholesterol homeostasis |

TABLE 52-continued miRNAs associated with disease phenotypes

| OMIM ID: | Locus containing miRNA | Disease association: |
|---|---|---|
| 600592 | Minichromosome maintenance deficient (S. cerevisiae) 7 containing miR-93 (Mourelatos) and miR-25 and miR-94 | increased chromosomal loss, DNA replication and recombination |
| 600700 | LIM domain-containing preferred translocation partner in lipoma containing miR-28 | Lipoma; Leukemia, myeloid |
| 600758 | Focal adhesion kinase, p125/mir-151 | oncogenesis |
| 601009 | tight junction protein 1 (zona occludens 1)/hypothetical miRNA-183 | peptic ulcer disease and gastric carcinoma |
| 601029 | mesoderm specific transcript (mouse) homolog containing mir-240* (Kosik) | intrauterine and postnatal growth retardation |
| 601698 | protein tyrosine phosphatase, receptor type, N polypeptide 2 containing mir-153-2 | insulin-dependent diabetes mellitus (IDDM) |
| 601773 | protein tyrosine phosphatase, receptor type, N containing mir-153-1 | insulin-dependent diabetes mellitus (IDDM), 222100 |
| 603576 | melastatin 1 containing mir-211 | metastatic human melanoma |
| 603634 | ribosomal protein L5/hypothetical miRNA 168-2 | colorectal cancers |
| 603745 | slit (*Drosophila*) homolog 3 containing mir-218-2 | congenital diaphragmatic hernia |
| 603746 | slit (*Drosophila*) homolog 2 containing mir-218-1 | retinal ganglion cell axon guidance |
| 603803 | dachshund (*Drosophila*) homolog containing hypothetical miRNA-083 | cell proliferation during mammalian retinogenesis and pituitary development |
| 605317 | forkhead box P2/hypothetical miRNA 169 | autism & speech-language disorder-1, 602081 |
| 605547 | follistatin-like 1 containing mir-198 | systemic rheumatic diseases |
| 605575 | SMC4 (structural maintenance of chromosomes 4, yeast)-like 1 containing mir-16-3 and mir-15b | cell proliferation |
| 605766 | deleted in lymphocytic leukemia, 2 containing mir-16-1 and mir-15a-1 | B-cell chronic lymphocytic leukemia |
| 606157 | hypothetical protein FLJ11729 containing mir-103-2 | Neurodegeneration, pantothenate kinase-associated, 234200 (3); |
| 606160 | pantothenate kinase containing mir-107 | pantothenate kinase-associated neurodegeneration |
| 606161 | hypothetical protein FLJ12899 containing mir-103-1 | pantothenate kinase-associated neurodegeneration |

From these data, it was observed that several miRNAs are predicted to be associated with human disease states. For example, several studies of autistic disorder have demonstrated linkage to a similar region of 7q (the AUTS1 locus), leading to the proposal that a single genetic factor on 7q3 1 contributes to both autism and language disorders, and it has been reported that the FOXP2 gene, located on human 7q3 1, encoding a transcription factor containing a polyglutamine tract and a forkhead domain, is mutated in a severe monogenic form of speech and language impairment, segregating within a single large pedigree, and is also disrupted by a translocation. In one recent study, association and mutation screening analysis of the FOXP2 gene was performed to assess the impact of this gene on complex language impairments and autism, and it was concluded that coding-region variants in FOXP2 do not underlie the AUTS1 linkage and that the gene is unlikely to play a role in autism or more common forms of language impairment (Newbury, et al., *Am. J. Hum. Genet.* 2002, 70,1318-27). However, hypothetical mir-169 is also encoded by this same genetic locus, and it is possible that mutations affecting the hypothetical mir-169 miRNA could underlie the AUTS1 linkage and play a role in language impairment. To this end, oligomeric compounds targeting or mimicking the mir-169 miRNA may prove useful in the study, diagnosis, treatment or amelioration of this disease.

Example 30

Effects of Oligomeric Compounds Targeting miRNAs on Insulin Signaling and Hallmark Gene Expression in HepG2 Cells Additional oligomeric compounds were screened in the assays described in Example 18. As stated above, insulin inhibits the expression of IGFBP-1, PEPCK-c and follistatin mRNAs.

Protocols for treatment of HepG2 cells and transfection of oligomeric compounds are as described in Example 18. Also as described in Example 18, forty-four hours post-transfection, the cells in the transfected wells were treated with either no insulin ("basal" Experiment 3 (below), for identification of insulin-mimetic compounds) or with 1 nM insulin ("insulin treated" Experiment 4 (below), for identification of insulin sensitizers) for four hours. At the same time, in both plates, cells in some of the un-transfected control wells are treated with 100 nM insulin to determine maximal insulin response. At the end of the insulin or no-insulin treatment (forty-eight hours post-transfection), total RNA is isolated from both the basal and insulin treated (1 nM) 96-well plates, and the amount of total RNA from each sample is determined using a Ribogreen assay (Molecular Probes, Eugene, Oreg.). Real-time PCR is performed on all the total RNA samples using primer/probe sets for three insulin responsive genes: PEPCK-c, IGFBP-1 and follistatin. Expression levels for each gene are normalized to total RNA, and values ± standard deviation are expressed relative to the transfectant only and negative control oligonucleotides. The compound ISIS Number 186515 (AGGTAGCTTTGATTATGTAA; SEQ ID NO: 939) is targeted to IGFBP-1 and is a phosphorothioate 5-10-5 MOE gapmer where all cytosines are 5-methylcytosines, as is used as a transfection control. The oligomeric compound ISIS Number 340341 (TAGCTTATCAGACTGATGTTGA; SEQ ID NO: 236) is a uniform 2'-MOE phosphorothioate compound targeted to mir-104 (Mourelatos), ISIS 340362 (GACTGTTGAATCTCATGGCA; SEQ ID NO: 937) is a 5-10-5 gapmer compound also targeted to mir-104 (Mourelatos), and ISIS Number 341813 (AGACACGTGCACTG-TAGA;

SEQ ID NO: 938) is a uniform 2'-MOE phosphorothioate compound targeted to mir-139. Results of these experiments are shown in Tables 53 and 54.

TABLE 53

Experiment 3: Effects of oligomeric compounds targeting miRNAs on insulin-repressed gene expression in HepG2 cells

| ISIS NO: | SEQ ID NO | Pri-miRNA | IGFBP-1 (% UTC) | PEPCK-c (% UTC) | Follistatin (% UTC) |
|---|---|---|---|---|---|
| UTC | N/A | N/A | 100 | 100 | 100 |
| 29848 n-mer | 737 | N/A | 104 | 100 | 90 |
| 186515 | 939 | IGFBP-1 | 193 | 70 | 67 |
| 328384 | 493 | hypothetical miRNA-039 | 139 | 142 | 110 |
| 328677 | 586 | hypothetical miRNA-120 | 208 | 145 | 130 |
| 328685 | 594 | mir-219 | 157 | 219 | 100 |
| 328691 | 600 | mir-145 | 105 | 108 | 93 |
| 328759 | 668 | mir-216 | 356 | 98 | 266 |
| 328761 | 670 | hypothetical miRNA-138 | 118 | 48 | 91 |
| 328765 | 674 | mir-215 | 88 | 93 | 87 |
| 328773 | 682 | mir-15a-2 | 148 | 138 | 131 |
| 328779 | 688 | hypothetical mir-177 | 135 | 123 | 109 |
| 340341 | 236 | mir-104 (Mourelatos) | 110 | 129 | 94 |
| 340362 | 937 | mir-104 (Mourelatos) | 157 | 168 | 123 |
| 341813 | 938 | mir-139 | 137 | 121 | 100 |

Under "basal" conditions (without insulin), treatments of HepG2 cells with oligomeric compounds of the present invention resulting in decreased mRNA expression levels of the PEPCK-c, IGFBP-1 and/or follistatin marker genes indicate that the oligomeric compounds have an insulin mimetic effect. Treatments with oligomeric compounds of the present invention resulting in an increase in mRNA expression levels of the PEPCK-c, IGFBP-1 and/or follistatin marker genes indicate that these compounds inhibit or counteract the normal insulin repression of mRNA expression of these genes. From these data, it is evident that the oligomeric compound ISIS Number 328761 targeting hypothetical mir-138, for example, results in a 52% decrease in PEPCK-c mRNA, a marker widely considered to be insulin-responsive. Thus, this oligomeric compound may be useful as a pharmaceutical agent with insulin mimetic properties in the treatment, amelioration, or prevention of diabetes or other metabolic diseases.

TABLE 54

Experiment 4: Effects of oligomeric compounds targeting miRNAs on insulin-sensitization of gene expression in HepG2 cells

| ISIS NO: | SEQ ID NO | Pri-miRNA | IGFBP-1 (% UTC) | PEPCK-c (% UTC) | Follistatin (% UTC) |
|---|---|---|---|---|---|
| UTC(1 nm insulin) | N/A | N/A | 100 | 100 | 100 |
| 29848 n-mer | 737 | N/A | 92 | 90 | 95 |
| 186515 | 939 | IGFBP-1 | 105 | 40 | 39 |
| 328384 | 493 | hypothetical miRNA-039 | 102 | 114 | 121 |
| 328677 | 586 | hypothetical miRNA-120 | 159 | 117 | 118 |
| 328685 | 594 | mir-219 | 143 | 184 | 157 |
| 328691 | 600 | mir-145 | 101 | 97 | 104 |
| 328759 | 668 | mir-216 | 212 | 92 | 224 |
| 328761 | 670 | hypothetical miRNA-138 | 93 | 55 | 98 |
| 328765 | 674 | mir-215 | 94 | 73 | 97 |
| 328773 | 682 | mir-15a-2 | 136 | 93 | 148 |
| 328779 | 688 | hypothetical mir-177 | 128 | 78 | 119 |
| 340341 | 236 | mir-104 (Mourelatos) | 113 | 115 | 120 |
| 340362 | 937 | mir-104 (Mourelatos) | 129 | 104 | 119 |
| 341813 | 938 | mir-139 | 117 | 88 | 102 |

In HepG2 cells treated with 1 nM insulin, treatments with oligomeric compounds of the present invention resulting in a decrease in mRNA expression levels of the PEPCK-c, IGFBP-1 and/or follistatin marker genes indicate that these compounds have an insulin sensitization effect. Treatments with oligomeric compounds of the present invention resulting in an increase in mRNA expression levels of the PEPCK-c, IGFBP-1 and/or follistatin marker genes indicate that these compounds inhibit or counteract the normal insulin response of repression of mRNA expression of these genes.

From these data, it is evident that the oligomeric compounds, ISIS Number 328761 targeting hypothetical mir-138 and ISIS Number 328765 targeting mir-215, for example, were observed to result in a 45% and a 27% reduction, respectively, of PEPCK-c mRNA expression, widely considered to be a marker of insulin-responsiveness. Furthermore, mRNA levels of the IGFBP-1 and follistatin genes were also reduced. Thus, these oligomeric compounds may be useful as pharmaceutical agents with insulin-sensitizing properties in the treatment, amelioration, or prevention of diabetes or other metabolic diseases.

Example 31

Adipocyte Assay of Oligomeric Compounds

The effect of several oligomeric compounds of the present invention targeting miRNA target nucleic acids on the expression of markers of cellular differentiation was examined in differentiating adipocytes.

As described in Example 13, some genes known to be upregulated during adipocyte differentiation include HSL, aP2, Glut4 and PPARγ. These genes play important roles in the uptake of glucose and the metabolism and utilization of fats. An increase in triglyceride content is another well-established marker for adipocyte differentiation.

For assaying adipocyte differentiation, expression of the four hallmark genes, HSL, aP2, Glut4, and PPARγ, as well as triglyceride (TG) accumulation were measured as previously described in adipocytes transfected with uniform 2'-MOE or chimeric gapmer phosphorothioate (PS) oligomeric compounds. Triglyceride levels as well as mRNA levels for each of the four adipocyte differentiation hallmark genes are expressed as a percentage of untreated control (UTC) levels. Results are shown in Table 55.

TABLE 55

Effects of oligomeric compounds targeting miRNAs on expression of adipocyte differentiation markers

| ISIS Number | SEQ ID NO | TG | HSL | AP2 | Glut4 | PPAR gamma |
|---|---|---|---|---|---|---|
| UTC | N/A | 100 | 100 | 100 | 100 | 100 |
| ISIS-29848 n-mer | 737 | 89 | 84 | 89 | 96 | 100 |
| 327877 | 295 | 109 | 82 | 77 | 119 | 85 |
| 327888 | 306 | 132 | 134 | 102 | 84 | 103 |
| 327904 | 322 | 56 | 42 | 65 | 40 | 54 |
| 327909 | 327 | 132 | 130 | 88 | 132 | 96 |
| 327927 | 345 | 125 | 120 | 114 | 120 | 108 |
| 327928 | 346 | 45 | 52 | 77 | 39 | 57 |
| 327933 | 351 | 127 | 132 | 82 | 127 | 100 |
| 327937 | 355 | 81 | 77 | 76 | 63 | 92 |
| 327951 | 369 | 76 | 100 | 91 | 81 | 84 |
| 327953 | 371 | 94 | 94 | 92 | 112 | 90 |
| 327956 | 374 | 80 | 90 | 102 | 69 | 91 |
| 327960 | 378 | 47 | 52 | 52 | 34 | 76 |
| 328093 | 395 | 59 | 89 | 97 | 73 | 99 |
| 328112 | 414 | 92 | 89 | 73 | 97 | 79 |
| 328114 | 416 | 110 | 134 | 123 | 116 | 106 |
| 328132 | 434 | 120 | 89 | 81 | 67 | 94 |
| 328340 | 449 | 76 | 130 | 85 | 112 | 110 |
| 328362 | 471 | 73 | 83 | 59 | 80 | 78 |
| 328400 | 509 | 60 | 40 | 34 | 18 | 67 |
| 328417 | 526 | 83 | 98 | 87 | 68 | 94 |
| 328434 | 543 | 91 | 96 | 85 | 83 | 79 |
| 328651 | 560 | 93 | 109 | 84 | 78 | 106 |
| 328677 | 586 | 34 | 68 | 61 | 44 | 89 |
| 328685 | 594 | 50 | 100 | 73 | 69 | 91 |
| 328691 | 600 | 130 | 156 | 166 | 144 | 105 |
| 328759 | 668 | 87 | 105 | 108 | 66 | 95 |

For these data, values for triglyceride accumulation above 100 are considered to indicate that the compound has the ability to stimulate triglyceride accumulation, whereas values at or below 100 indicate that the compound inhibits triglyceride accumulation. With respect to leptin secretion, values above 100 are considered to indicate that the compound has the ability to stimulate secretion of the leptin hormone, and values at or below 100 indicate that the compound has the ability to inhibit secretion of leptin. With respect to the four adipocyte differentiation hallmark genes, values above 100 are considered to indicate induction of cell differentiation, whereas values at or below 100 indicate that the compound inhibits differentiation.

Several compounds were found to have remarkable effects. For example, the oligomeric compounds ISIS Number 327904 (SEQ ID NO: 322), targeted to mir-181a-1, ISIS Number 327928 (SEQ ID NO: 346), targeted to mir-29a, ISIS Number 327960 (SEQ ID NO: 378), targeted to mir-215, ISIS Number 328400 (SEQ ID NO: 509), targeted to mir-196-2, and ISIS Number 328677 (SEQ ID NO: 586), targeted to hypothetical miRNA-120 were shown to reduce the expression levels of all five markers of adipocyte differentiation, indicating that these oligomeric compounds have the ability to block adipocyte differentiation. Therefore, these oligomeric compounds may be useful as therapeutic agents with applications in the treatment, attenuation or prevention of obesity, hyperlipidemia, atherosclerosis, atherogenesis, diabetes, hypertension, or other metabolic diseases as well as in the maintenance of the pluripotent phenotype of stem or precursor cells.

The oligomeric compounds ISIS Number 328691 (SEQ ID NO: 600) targeted to mir-145, ISIS Number 328114 (SEQ ID NO: 416) targeted to hypothetical miRNA-138, and ISIS Number 327927 (SEQ ID NO: 345) targeted to mir-15b are examples of compounds which exhibit an increase in all five markers of adipocyte differentiation. Additionally, the oligomeric compound ISIS Number 327909 (SEQ ID NO: 327) targeted to mir-196-2 exhibited an increase in three of the five markers of adipocyte differentiation. Thus, these oligomeric compounds may be useful as pharmaceutical agents in the treatment of diseases in which the induction of adipocyte differentiation is desirable, such as anorexia, or for conditions or injuries in which the induction of cellular differentiation is desireable, such as Alzheimers disease or central nervous system injury, in which regeneration of neural tissue would be beneficial. Furthermore, these oligomeric compounds may be useful in the treatment, attenuation or prevention of diseases in which it is desireable to induce cellular differentiation and/or quiescence, for example in the treatment of hyperproliferative disorders such as cancer.

Example 32

Effects of Oligomeric Compounds on Endothelial Tube Formation Assay

Angiogenesis is the growth of new blood vessels (veins and arteries) by endothelial cells. This process is important in the development of a number of human diseases, and is believed to be particularly important in regulating the growth of solid tumors. Without new vessel formation it is believed that tumors will not grow beyond a few millimeters in size. In addition to their use as anti-cancer agents, inhibitors of angiogenesis have potential for the treatment of diabetic retinopathy, cardiovascular disease, rheumatoid arthritis and psoriasis (Carmeliet and Jain, *Nature*, 2000, 407, 249-257; Freedman and Isner, *J. Mol. Cell. Cardiol.*, 2001, 33, 379-393; Jackson et al., *Faseb J.*, 1997, 11, 457-465; Saaristo et al., *Oncogene*, 2000, 19, 6122-6129; Weber and De Bandt, *Joint Bone Spine*, 2000, 67, 366-383; Yoshida et al., *Histol. Histopathol.*, 1999, 14, 1287-1294).

Endothelial Tube Formation Assay as a Measure of Angiogenesis:

Angiogenesis is stimulated by numerous factors that promote interaction of endothelial cells with each other and with extracellular matrix molecules, resulting in the formation of capillary tubes. This morphogenic process is necessary for the delivery of oxygen to nearby tissues and plays an essential role in embryonic development, wound healing, and tumor growth (Carmeliet and Jain, *Nature*, 2000, 407, 249-257). Moreover, this process can be reproduced in a tissue culture assay that evaluates the formation of tube-like structures by endothelial cells. There are several different variations of the assay that use different matrices, such as collagen I (Kanayasu et al., *Lipids*, 1991, 26, 271-276), Matrigel (Yamagishi et al., *J. Biol. Chem.*, 1997, 272, 8723-8730) and fibrin (Bach et al., *Exp. Cell Res.*, 1998, 238, 324-334), as growth substrates for the cells. In this assay, human umbilical vein endothelial cells (HuVECs) are plated on a matrix derived from the Engelbreth-Holm-Swarm mouse tumor, which is very similar to Matrigel (Kleinman et al., *Biochemistry*, 1986, 25, 312-318; Madri and Pratt, *J. Histochem. Cytochem.*, 1986, 34, 85-91). Untreated HuVECs form tube-like structures when grown on this substrate. Loss of tube formation in vitro has been correlated with the inhibition of angiogenesis in vivo (Carmeliet and Jain, *Nature*, 2000, 407, 249-257; Zhang et al., *Cancer Res.*, 2002, 62, 2034-2042), which supports the use of in vitro tube formation as an endpoint for angiogenesis.

In one embodiment, primary human umbilical vein endothelial cells (HuVECs) were used to measure the effects of oligomeric compounds targeted to miRNAs on tube formation activity. HuVECs were routinely cultured in EBM (Clonetics Corporation, Walkersville, Md.) supplemented with SingleQuots supplements (Clonetics Corporation, Walkersville, Md.). Cells were routinely passaged by trypsinization and dilution when they reached 90% confluence and were maintained for up to 15 passages. HuVECs are plated at 3000 cells/well in 96-well plates. One day later, cells are transfected with oligomeric compounds. The tube formation assay is performed using an in vitro Angiogenesis Assay Kit (Chemicon International, Temecula, Calif.).

A scrambled control compound, ISIS 29848 (NNNNNNNNNNNNNNNNNNNN: where N is A,T,C or G; herein incorporated as SEQ ID NO: 737) served as a negative control. ISIS 196103 (AGCCCATTGCTGGACAT-GCA; incorporated herein as SEQ ID NO: 940) targets integrin beta 3 and was used as a positive control to inhibit endothelial tube formation. ISIS 29248 and ISIS 196103 are chimeric 5-10-5 2'-MOE gapmer oligonucleotides. The internucleoside (backbone) linkages are phosphorothioate (P=S) throughout the oligonucleotides. All cytidine residues are 5-methylcytidines. ISIS 342672 (SEQ ID NO: 789) contains 13 mismatches with respect to the mature mir-143 miRNA, and was also used as a negative control. ISIS 342672 is a uniform 2'-MOE phosphorothioate oligomeric compound 22 nucleotides in length. All cytidine residues are 5-methylcytidines.

Oligomeric compound was mixed with LIPOFECTIN™ (Invitrogen Life Technologies, Carlsbad, Calif.) in OPTI-MEM™ (Invitrogen Life Technologies, Carlsbad, Calif.) to achieve a final concentration of 75 nM of oligomeric compound and 2.25 µg/mL LIPOFECTIN™. Before adding to cells, the oligomeric compound, LIPOFECTIN™ and OPTI-MEM™ were mixed thoroughly and incubated for 0.5 hrs. Untreated control cells received LIPOFECTIN™ only. The medium was removed from the plates and the plates were tapped on sterile gauze. Each well was washed in 150 µl of phosphate-buffered saline. The wash buffer in each well was replaced with 100 µL of the oligomeric compound/OPTI-MEM™/LIPOFECTIN™ cocktail. Compounds targeted to miRNAs were tested in triplicate, and ISIS 29848 was tested in up to six replicates. The plates were incubated for 4 hours at 37° C., after which the medium was removed and the plate was tapped on sterile gauze. 100 µl of full growth medium was added to each well. Fifty hours after transfection, cells are transferred to 96-well plates coated with ECMa-trix™ (Chemicon International). Under these conditions, untreated HuVECs form tube-like structures. After an overnight incubation at 37° C., treated and untreated cells are inspected by light microscopy. Individual wells are assigned discrete scores from 1 to 5 depending on the extent of tube formation. A score of 1 refers to a well with no tube formation while a score of 5 is given to wells where all cells are forming an extensive tubular network. Results are expressed as a percentage of the level of the tube formation observed in cultures not treated with oligonucleotide, and are shown in Tables 56-59.

TABLE 56

Effect of compounds targeting miRNAs on Tube Formation Activity in HuVECs

| ISIS NO: | SEQ ID NO: | Pri-miRNA | % Activity Relative to UTC |
|---|---|---|---|
| UTC | N/A | N/A | 100 |
| 196103 positive control | 940 | Integrin beta 3 | 35.7 |
| 342672 negative control | 789 | N/A | 46.4 |
| 327873 | 291 | mir-140 | 100.0 |
| 327875 | 293 | mir-34 | 71.4 |
| 327876 | 294 | mir-29b-1 | 50.0 |
| 327877 | 295 | mir-16-3 | 78.6 |
| 327878 | 296 | mir-203 | 57.1 |
| 327879 | 297 | mir-7-1 | 71.4 |
| 327880 | 298 | mir-10b | 57.1 |
| 327881 | 299 | mir-128a | 50.0 |
| 327882 | 300 | mir-153-1 | 107.1 |
| 327883 | 301 | mir-27b | 92.9 |
| 327884 | 302 | mir-96 | 78.6 |
| 327885 | 303 | mir-17as/mir-91 | 50.0 |
| 327886 | 304 | mir-123/mir-126as | 42.9 |
| 327887 | 305 | mir-132 | 57.1 |
| 327888 | 306 | mir-108-1 | 100.0 |
| 327889 | 307 | mir-23b | 50.0 |
| 327890 | 308 | let-7i | 92.9 |
| 327891 | 309 | mir-212 | 50.0 |
| 327892 | 310 | mir-131-2/mir-9 | 57.1 |
| 327893 | 311 | let-7b | 100.0 |
| 327894 | 312 | mir-1d | 100.0 |
| 327895 | 313 | mir-122a | 100.0 |
| 327896 | 314 | mir-22 | 64.3 |
| 327898 | 316 | mir-142 | 100.0 |

From these data, it was observed that ISIS Number 327886 targeted to mir-123/mir126as suppressed tube formation, indicating that this compound may be useful as an angiogenesis inhibitor and/or anti-tumor agent, with potential therapeutic applications in the treatment of diabetic retinopathy, cardiovascular disease, rheumatoid arthritis, psoriasis, as well as cancer.

TABLE 57

Effect of compounds targeting miRNAs on Tube Formation Activity in HuVECs

| ISIS NO: | SEQ ID NO: | Pri-miRNA | % Activity Relative to UTC |
|---|---|---|---|
| UTC | N/A | N/A | 100 |
| 196103 positive control | 940 | Integrin beta 3 | 24.1 |
| 342672 negative control | 789 | N/A | 58.6 |
| 327899 | 317 | mir-183 | 34.5 |
| 327900 | 318 | mir-214 | 55.2 |
| 327901 | 319 | mir-143 | 48.3 |
| 327902 | 320 | mir-192-1 | 41.4 |
| 327903 | 321 | let-7a-3 | 103.5 |
| 327904 | 322 | mir-181a | 89.7 |
| 327905 | 323 | mir-205 | 48.3 |
| 327906 | 324 | mir-103-1 | 69.0 |
| 327907 | 325 | mir-26a | 62.1 |
| 327908 | 326 | mir-33a | 103.5 |
| 327909 | 327 | mir-196-2 | 96.6 |
| 327910 | 328 | mir-107 | 55.2 |
| 327911 | 329 | mir-106 | 75.9 |
| 327913 | 331 | mir-29c | 69.0 |

TABLE 57-continued

Effect of compounds targeting miRNAs on Tube Formation Activity in HuVECs

| ISIS NO: | SEQ ID NO: | Pri-miRNA | % Activity Relative to UTC |
|---|---|---|---|
| 327914 | 332 | mir-130a | 82.8 |
| 327915 | 333 | mir-218-1 | 69.0 |
| 327916 | 334 | mir-124a-2 | 96.6 |
| 327917 | 335 | mir-21 | 82.8 |
| 327918 | 336 | mir-144 | 96.6 |
| 327919 | 337 | mir-221 | 103.5 |
| 327920 | 338 | mir-222 | 41.4 |
| 327921 | 339 | mir-30d | 96.6 |
| 327922 | 340 | mir-19b-2 | 89.7 |
| 327923 | 341 | mir-128b | 48.3 |

From these data, it was observed that ISIS Number 327899 targeted to mir-183, ISIS Number 327902 targeted to mir-192-1, and ISIS Number 327920 targeted to mir-222 suppressed tube formation, indicating that these compounds may be useful as an angiogenesis inhibitors and/or anti-tumor agents, with potential therapeutic applications in the treatment of diabetic retinopathy, cardiovascular disease, rheumatoid arthritis, psoriasis, as well as cancer.

TABLE 58

Effect of compounds targeting miRNAs on Tube Formation Activity in HuVECs

| ISIS NO: | SEQ ID NO: | Pri-miRNA | % Activity Relative to UTC |
|---|---|---|---|
| UTC | N/A | N/A | 100 |
| 196103 positive control | 940 | Integrin beta 3 | 29.6 |
| 342672 negative control | 789 | N/A | 55.6 |
| 327924 | 342 | mir-129-2 | 88.9 |
| 327925 | 343 | mir-133b | 44.4 |
| 327926 | 344 | let-7d | 96.3 |
| 327927 | 345 | mir-15b | 59.3 |
| 327928 | 346 | mir-29a-1 | 37.0 |
| 327929 | 347 | mir-199b | 51.9 |
| 327930 | 348 | let-7e | 88.9 |
| 327931 | 349 | let-7c | 103.7 |
| 327932 | 350 | mir-204 | 51.9 |
| 327933 | 351 | mir-145 | 59.3 |
| 327934 | 352 | mir-213/mir-181a | 51.9 |
| 327935 | 353 | mir-20 | 74.1 |
| 327936 | 354 | mir-133a-1 | 51.9 |
| 327937 | 355 | mir-138-2 | 88.9 |
| 327938 | 356 | mir-98 | 96.3 |
| 327939 | 357 | mir-125b-1 | 66.7 |
| 327940 | 358 | mir-199a-2 | 59.3 |
| 327941 | 359 | mir-181b | 74.1 |
| 327942 | 360 | mir-141 | 74.1 |
| 327943 | 361 | mir-18 | 81.5 |
| 327944 | 362 | mir-220 | 37.0 |
| 327945 | 363 | mir-24-2 | 59.3 |
| 327946 | 364 | mir-211 | 51.9 |
| 327947 | 365 | mir-101-3 | 81.5 |

From these data, it was observed that ISIS Number 327925 targeted to mir-133b, ISIS Number 7928 targeted to mir-29a-1, and ISIS Number 327944 targeted to mir-220 suppressed tube formation, indicating that these compounds may be useful as an angiogenesis inhibitors and/or anti-tumor agents, with potential therapeutic applications in the treatment of diabetic retinopathy, cardiovascular disease, rheumatoid arthritis, psoriasis, as well as cancer.

TABLE 59

Effect of compounds targeting miRNAs on Tube Formation Activity in HuVECs

| ISIS Number | SEQ ID NO: | Pri-miRNA | % Activity Relative to UTC |
|---|---|---|---|
| UTC | N/A | N/A | 100 |
| 196103 positive control | 940 | Integrin beta 3 | 26.7 |
| 342672 negative control | 789 | N/A | 60.0 |
| 327874 | 292 | mir-30a | 46.7 |
| 327897 | 315 | mir-92-1 | 40.0 |
| 327901 | 319 | mir-143 | 100.0 |
| 327948 | 366 | mir-30b | 33.3 |
| 327949 | 367 | mir-10a | 66.7 |
| 327950 | 368 | mir-19a | 73.3 |
| 327951 | 369 | mir-15a-1 | 73.3 |
| 327952 | 370 | mir-137 | 53.3 |
| 327953 | 371 | mir-219 | 53.3 |
| 327954 | 372 | mir-148b | 53.3 |
| 327955 | 373 | mir-130b | 46.7 |
| 327956 | 374 | mir-216 | 46.7 |
| 327957 | 375 | mir-100-1 | 66.7 |
| 327958 | 376 | mir-187 | 40.0 |
| 327959 | 377 | mir-210 | 40.0 |
| 327960 | 378 | mir-215 | 53.3 |
| 327961 | 379 | mir-223 | 53.3 |
| 327962 | 380 | mir-30c | 53.3 |
| 327963 | 381 | mir-26b | 93.3 |
| 327964 | 382 | mir-152 | 86.7 |
| 327965 | 383 | mir-135-1 | 100.0 |
| 327966 | 384 | mir-217 | 40.0 |
| 327967 | 385 | let-7g | 93.3 |
| 327968 | 386 | mir-33b | 93.3 |

From these data, it was observed that ISIS Number 327948 targeted to mir-30b, ISIS Number 327958 targeted to mir-187, ISIS Number 327959 targeted to mir-210, and ISIS Number 327966 targeted to mir-217 suppressed tube formation, indicating that these compounds may be useful as an angiogenesis inhibitors and/or anti-tumor agents, with potential therapeutic applications in the treatment of diabetic retinopathy, cardiovascular disease, rheumatoid arthritis, psoriasis, as well as cancer.

Example 33

Effect of Oligomeric Compounds on miRNA Target Protein Expression

Several mRNA transcripts have been predicted to be regulated by miRNAs (Lewis et al., Cell, 2003, 115, 787-798). For example, the mRNAs encoded by six genes, 1) inwardly rectifying potassium channel Kir2.2 (GenBank Accession AB074970, SEQ ID NO: 872); 2) synaptotagmin III (GenBank Accession BC028379, SEQ ID NO: 873); 3) mitogen-activated protein kinase 7/extracellular signal-regulated kinase 5 (ERK5) (GenBank Accession NM_139032.1, SEQ ID NO: 861); 4) protein phosphatase 2 (formerly 2A), catalytic subunit, beta isoform (PPP2CB) (GenBank Accession NM_004156.1, SEQ ID NO: 814); 5) glyoxalase I (GenBank Accession NM_006708.1, SEQ ID NO: 821); and 6) LIM domain only 4 (LMO4) (GenBank Accession NM_006769.2, SEQ ID NO: 865), are believed to have mir-143 binding sites within their 3'-UTRs. The latter three genes encode mRNAs that were identified as potential targets of mir-143 by the RACE-PCR experiments described, supra. Thus, the mir-143 miRNA is predicted to regulate some or all of these genes.

When miRNAs have effects on the expression of downstream genes or proteins encoded by these genes, it is advantageous to measure the protein levels of those gene products, and to do this, western blot (immunoblot) analysis is employed. Immunoblot analysis is carried out using standard methods. Briefly, preadipocytes and differentiating adipocytes were cultured as described previously, and differentiating adipocytes are sampled at several timepoints after stimulation of differentiation. Cells were treated with 250 nM oligomeric compounds and harvested 16-20 h after oligomeric compound treatment. Cells were washed, lysed in RIPA buffer with protease inhibitor cocktail (Roche Diagnostics Corporation, Indianapolis, Ind.), suspended in Laemmli buffer (20 ul/well), boiled for 5 minutes and loaded onto either an 8% SDS-PAGE or a 4-20% gradient SDS-PAGE gel. Gels are run for approximately 1.5 hours at 150 V, and transferred to PVDF membrane for western blotting. Appropriate primary antibody directed to a target is used, with a radiolabeled or fluorescently labeled secondary antibody directed against the primary antibody species. Because expression levels of the glyceraldehyde-3-phosphate dehydrogenase (GAPDH) protein remain constant, an antibody recognizing the GAPDH protein (Abcam, Cambridge, Mass.) can be used in a re-probing of the membrane to verify equal protein loading. It is also understood that antisense oligomeric compounds specifically targeting and known to inhibit the expression of the mRNA and protein endproducts of the gene of interest can be used as controls in these experiments. Bands are visualized and quantitated using a PHOSPHORIMAGER™ (Molecular Dynamics, Sunnyvale Calif.) or the ChemiDoc™ system (Bio-Rad Laboratories, Inc., Hercules, Calif.). Thus, the effects of treatment of many cell types (including, but not limited to, preadipocytes, differentiating adipocytes, HeLa, T-24 and A549 cells) with oligomeric compounds of the present invention on the levels of gene expression products can be assessed. It is understood that one of ordinary skill in the art can use immunoblot analysis to examine the expression of any protein predicted to be the downstream expression product of a target of a miRNA. Similarly, using methods described above, real-time RT-PCR methods can also be used to examine the mRNA expression levels of any of these predicted targets of the mir-143 miRNA. More specifically, immunoblot analysis and/or real-time RT-PCR methods can be used to examine the effects of treatment with oligomeric compounds on the protein or mRNA levels, respectively, produced by the Kir2.2, synaptotagmin III, ERK5, PPP2CB, glyoxalase I, and/or LMO4 genes in a variety of cell types.

In one embodiment of the invention, immunoblot analysis was used to assess the effects of the oligomeric compound, ISIS Number 327901 (SEQ ID NO: 319) targeting mir-143, on expression levels of the PPP2CB protein in differentiating adipocytes. It was observed that, upon treatment with ISIS 327901, PPP2CB protein levels were higher in differentiating adipocytes both 7- and 10-days post-differentiation than in pre-adipocytes or in untreated differentiating adipocytes from the same timepoints. Thus, mir-143 appears to negatively regulate the expression of the PPP2CB gene, presumably by inhibiting translation of the PPP2CB mRNA into protein, and upon treatment with the oligomeric compound ISIS 327901, this inhibition of PPP2CB protein expression was relieved.

In one embodiment of the invention, immunoblot analysis was used to assess the effects of the oligomeric compound, ISIS Number 327901 (SEQ ID NO: 319) targeting mir-143, on expression levels of the ERK5 protein in differentiating adipocytes. It was observed that, upon treatment of cells with ISIS 327901, ERK5 protein levels were approximately 2-2.5-fold higher in differentiating adipocytes both 7- and 10-days post-differentiation than in pre-adipocytes or in untreated differentiating adipocytes from the same timepoints. Thus, mir-143 appears to negatively regulate the expression of the ERK5 gene presumably by inhibiting translation of the ERK5 mRNA into protein, either directly (by mir-143 binding an ERK5 cis-regulatory sequence) or indirectly (by mir-143 regulating another target gene that regulates ERK5); upon treatment with the oligomeric compound ISIS 327901, this mir-143-dependent inhibition of ERK5 expression was relieved. It is known that ERK5 promotes cell growth and proliferation in response to tyrosine kinase signaling. In light of the involvement of mir-143 in adipocyte differentiation disclosed in several examples in the present invention, as well as the role of mir-143 in regulating ERK5, it is predicted that ERK5 and mir-143 are together involved regulating the balance between cellular proliferation and differentiation.

It is understood that the oligomeric compounds of the present invention, including miRNA mimics, can also be tested for their effects on the expression of the protein endproducts of targets of miRNAs. For example, an oligomeric compound such as a mir-143 mimic can be used to treat differentiating adipocytes, and is predicted to result in a reduction of Kir2.2, synaptotagmin III, ERK5, PPP2CB, glyoxalase I, and/or LMO4 protein expression levels.

The phosphatase and tensin homolog (mutated in multiple advanced cancers 1) (PTEN) tumor suppressor mRNA (GenBank Accession NM_000314, incorporated herein as SEQ ID NO: 941) has been predicted to be a potential target of the mir-19a miRNA (Lewis et al., Cell, 2003, 115, 787-798). Oligomeric compounds that target or mimic the mir-19a miRNA or mir-19a pri-miRNA can be used to treat cells and, using the methods described above, the effects of these oligomeric compounds on the expression of the PTEN protein and mRNA levels can be assessed. It is predicted that the mir-19a miRNA, or an oligomeric compound acting as a mir-19a mimic, would inhibit expression of the PTEN tumor suppressor mRNA and protein, and that treatment with oligomeric compounds targeting mir-19a would reverse this inhibition. It is also understood that other antisense oligomeric compounds specifically targeting and known to inhibit the expression of the mRNA and protein endproducts of the gene interest can be used as controls in these experiments.

Example 34

Additional Oligomeric Compounds Targeting miRNAs

In accordance with the present invention, oligomeric compounds were designed and synthesized to target or mimic one or more miRNA genes or gene products. Pri-miRNAs, pre-miRNAs and mature miRNAs represent target nucleic acids to which the oligomeric compounds of the present invention were designed and synthesized. Oligomeric compounds of the present invention can also be designed and synthesized to mimic the pri-miRNA, pre-miRNA or mature miRNA structure while incorporating certain chemical modifications that alter one or more properties of the mimic, thus creating a construct with superior properties as compared to the endogenous precursor or mature miRNA.

In accordance with the present invention, oligomeric compounds were designed to target or mimic one or more human, mouse, rat, or *Drosophila* pri-miRNAs, pre-miRNAs or mature miRNAs.

A list of human pri-miRNAs and the mature miRNAs predicted to derive from them is shown in Table 60. "Pri-miRNA name" indicates the gene name for each of the pri-miRNAs, and "pri-miRNA sequence" indicates the sequence of the predicted primary miRNA transcript. Also given in table 60 are the name and sequence of the mature miRNA derived from the pri-miRNA. Mature miRNA sequences from pri-miRNA precursors have been proposed by several groups; consequently, for a given pri-miRNA sequence, several miRNAs may be disclosed and given unique names, and thus a given pri-miRNA sequence may occur repeatedly in the table. The sequences are written in the 5' to 3' direction and are represented in the DNA form. It is understood that a person having ordinary skill in the art would be able to convert the sequence of the targets to their RNA form by simply replacing the thymidine (T) with uracil (U) in the sequence.

TABLE 60

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-27b | TGACCTCTCTAACAAG GTGCAGAGCTTAGCTG ATTGGTGAACAGTGAT TGGTTTCCGCTTTGTT CACAGTGGCTAAGTTC TGCACCTGAAGAGAAG GTGAGATGGGGACA | 17 | mir-27b | TTCACAGTGGCTAAGTTCTG | 202 |
| mir-27b | TGACCTCTCTAACAAG GTGCAGAGCTTAGCTG ATTGGTGAACAGTGAT TGGTTTCCGCTTTGTT CACAGTGGCTAAGTTC TGCACCTGAAGAGAAG GTGAGATGGGGACA | 17 | miR-27* (Michael et al) | TTCACAGTGGCTAAGTTCTGC | 1059 |
| mir-23b | GCGCTGCTCTCAGGTG CTCTGGCTGCTTGGGT TCCTGGCATGCTGATT TGTGACTTAAGATTAA AATCACATTGCCAGGG ATTACCACGCAACCAC GACCTTGGCTGCTC | 23 | mir-23b | ATCACATTGCCAGGGATTACCAC | 208 |
| glutamate receptor, ionotrophic, AMPA 3/hypothetical miRNA-033 | TGGTGTGGCAACCCCT AAAGGCTCAGCATTAA GGTGGGTGGAATAATA TAACAATATCCGTGTT GTTATAGTATTCCACC TACCCTGATGCATTTT GTTGTCATTTTCTT | 36 | hypothetical miRNA-033 | TGTTATAGTATTCCACCTACC | 1060 |
| LOC 114614 containing miR-155/ hypothetical miRNA-071 | GCTTGCTGTAGGCTGT ATGCTGTTAATGCTAA TCGTGATAGGGGTTTT TGCCTCCAACTGACTC CTACATATTAGCATTA ACAGTGTATGATGCCT GTTACTAGCATTCA | 74 | hypothetical miRNA-071 | TGCTAATCGTGATAGGGGTTT | 1061 |
| LOC 114614 containing miR-155/ hypothetical miRNA-071 | GCTTGCTGTAGGCTGT ATGCTGTTAATGCTAA TCGTGATAGGGGTTTT TGCCTCCAACTGACTC CTACATATTAGCATTA ACAGTGTATGATGCCT GTTACTAGCATTCA | 74 | mir-155 (RFAM) | TTAATGCTAATCGTGATAGGGG | 1062 |
| collagen, type I, alpha 1/ hypothetical miRNA-144 | CACGCATGAGCGGACG CTAACCCCCTCCCCAG CCACAAAGAGTCTACA TGTCTAGGGTCTAGAC ATGTTCAGCTTTGTGG ACCTCCGGCTCCTGCT CCTCTTAGCGGCCA | 147 | hypothetical miRNA-144 | AGACATGTTCAGCTTTGTGGA | 1063 |
| sterol regulatory element- binding protein-1/ mir-33b | GGGGGCCGAGAGAGGC GGGCGGCCCCGCGGTG CATTGCTGTTGCATTG CACGTGTGTGAGGCGG GTGCAGTGCCTCGGCA GTGCAGCCCGGAGCCG GCCCCTGGCACCAC | 168 | mir-33b | GTGCATTGCTGTTGCATTG | 286 |
| tight junction | ACTCCAGGTGAAACAC TGCTGAGTCCTTTGGT | 186 | hypothetical | AGCCTGTGGAGCTGCGCTTAC | 1064 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| protein 1 (zona occludens 1)/ hypothetical miRNA-183 | GATGTGTGGTCCCCAT GGCCTCAAGTTCCTGA AGCCTGTGGAGCTGCG CTTACCACACTGTGCG TCCATGACTCCTGA | | miRNA-183 | | |
| mir-140 | CTGTGTGTGTCTCTCT CTGTGTCCTGCCAGTG GTTTTACCCTATGGTA GGTTACGTCATGCTGT TCTACCACAGGGTAGA ACCACGGACAGGATAC CGGGGCACCCTCTG | 4 | mir-140 | AGTGGTTTTACCCTATGGTAG | 192 |
| mir-140 | CTGTGTGTGTCTCTCT CTGTGTCCTGCCAGTG GTTTTACCCTATGGTA GGTTACGTCATGCTGT TCTACCACAGGGTAGA ACCACGGACAGGATAC CGGGGCACCCTCTG | 4 | miR-140-as | TACCACAGGGTAGAACCACGGA | 1065 |
| mir-140 | CTGTGTGTGTCTCTCT CTGTGTCCTGCCAGTG GTTTTACCCTATGGTA GGTTACGTCATGCTGT TCTACCACAGGGTAGA ACCACGGACAGGATAC CGGGGCACCCTCTG | 4 | mir-239* (Kosik) | TACCACAGGGTAGAACCACGGACA | 1066 |
| mir-34 | GGCCAGCTGTGAGTGT TTCTTTGGCAGTGTCT TAGCTGGTTGTTGTGA GCAATAGTAAGGAAGC AATCAGCAAGTATACT GCCCTAGAAGTGCTGC ACGTTGTGGGGCCC | 6 | mir-34 | TGGCAGTGTCTTAGCTGGTTGT | 194 |
| mir-34 | GGCCAGCTGTGAGTGT TTCTTTGGCAGTGTCT TAGCTGGTTGTTGTGA GCAATAGTAAGGAAGC AATCAGCAAGTATACT GCCCTAGAAGTGCTGC ACGTTGTGGGGCCC | 6 | miR-172 (RFAM-M.mu.) | TGGCAGTGTCTTAGCTGGTTGTT | 1067 |
| mir-203 | GTGTTGGGGACTCGCG CGCTGGGTCCAGTGGT TCTTAACAGTTCAACA GTTCTGTAGCGCAATT GTGAAATGTTTAGGAC CACTAGACCGGGCGGG CGCGGCGACAGCGA | 10 | mir-203 | GTGAAATGTTTAGGACCACTAG | 197 |
| mir-203 | GTGTTGGGGACTCGCG CGCTGGGTCCAGTGGT TCTTAACAGTTCAACA GTTCTGTAGCGCAATT GTGAAATGTTTAGGAC CACTAGACCCGGCGGG CGCGGCGACAGCGA | 10 | miR-203 (RFAM-M.mu.) | TCAAATGTTTAGGACCACTAG | 1068 |
| mir-203 | GTGTTGGGGACTCGCG CGCTGGGTCCAGTGGT TCTTAACAGTTCAACA GTTCTGTAGCGCAATT GTGAAATGTTTAGGAC CACTAGACCCGGCGGG CGCGGCGACAGCGA | 10 | miR-203 (Tuschl) | TGAAATGTTTAGGACCACTAGA | 1069 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-7_1/mir-7_1* | TTGGATGTTGGCCTAG TTCTGTGTGGAAGACT AGTGATTTTGTTGTTT TTAGATAACTAAATCG ACAACAAATCACAGTC TGCCATATGGCACAGG CCATGCCTCTACAG | 11 | mir-7_1*_Ruv kun | CAACAAATCACAGTCTGCCATA | 1070 |
| mir-7_1/mir-7_1* | TTGGATGTTGGCCTAG TTCTGTGTGGAAGACT AGTGATTTTGTTGTTT TTAGATAACTAAATCG ACAACAAATCACAGTC TGCCATATGGCACAGG CCATGCCTCTACAG | 11 | mir-7 | TGGAAGACTAGTGATTTTGTT | 198 |
| mir-10b | CCAGAGGTTGTAACGT TGTCTATATATACCCT GTAGAACCGAATTTGT GTGGTATCCGTATAGT CACAGATTCGATTCTA GGGGAATATATGGTCG ATGCAAAAACTTCA | 12 | miR-10b (Tuschl) | CCCTGTAGAACCGAATTTGTGT | 1071 |
| mir-10b | CCAGAGGTTGTAACGT TGTCTATATATACCCT GTAGAACCGAATTTGT GTGGTATCCGTATAGT CACAGATTCGATTCTA GGGGAATATATGGTCG ATGCAAAAACTTCA | 12 | mir-10b | TACCCTGTAGAACCGAATTTGT | 199 |
| mir-10b | CCAGAGGTTGTAACGT TGTCTATATATACCCT GTAGAACCGAATTTGT GTGGTATCCGTATAGT CACAGATTCGATTCTA GGGGAATATATGGTCG ATGCAAAAACTTCA | 12 | miR-10b (Michael et al) | TACCCTGTAGAACCGAATTTGTG | 1072 |
| mir-128a | TGCAATAATTGGCCTT GTTCCTGAGCTGTTGG ATTCGGGGCCGTAGCA CTGTCTGAGAGGTTTA CATTTCTCACAGTGAA CCGGTCTCTTTTTCAG CTGCTTCCTGGCTT | 13 | mir-128 (Kosik) | TCACAGTGAACCGGTCTCTTT | 1073 |
| mir-128a | TGCAATAATTGGCCTT GTTCCTGAGCTGTTGG ATTCGGGGCCGTAGCA CTGTCTGAGAGGTTTA CATTTCTCACAGTGAA CCGGTCTCTTTTTCAG CTGCTTCCTGGCTT | 13 | mir-128a | TCACAGTGAACCGGTCTCTTTT | 200 |
| mir-153_1 | TCTCTCTCTCCCTCAC AGCTGCCAGTGTCATT TTTGTGATCTGCAGCT AGTATTCTCACTCCAG TTGCATAGTCACAAAA GTGATCATTGGCAGGT GTGGCTGCTGCATG | 14 | mir-153 | TTGCATAGTCACAAAAGTGA | 201 |
| mir-153_2 | TGCCAGCTAATTAGCG GTGGCCAGTGTCATTT TTGTGATGTTGCAGCT AGTAATATGAGCCCAG TTGCATAGTCACAAAA GTGATCATTGGAAACT GTGACTGTACTGCA | 15 | mir-153 | TTGCATAGTCACAAAAGTGA | 201 |
| hypo-thetical miR-13/ | CTGGATGCCTTTTCTG CAGGCCTCTGTGTGAT ATGTTTGATATATTAG | 16 | hypo-thetical miRNA- | TATCAAACATATTCCTACAGT | 1074 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| miR-190 | GTTGTTATTTAATCCA ACTATATATCAAACAT ATTCCTACAGTGTCTT GCCCTGTCTCCGGG | | 013 | | |
| hypo- thetical miR-13/ miR-190 | CTGGATGCCTTTTCTG CAGGCCTCTGTGTGAT ATGTTTGATATATTAG GTTGTTATTTAATCCA ACTATATATCAAACAT ATTCCTACAGTGTCTT GCCCTGTCTCCGGG | 16 | miR-190 | TGATATGTTTGATATATTAGGT | 1075 |
| mir-123/ mir-126 | GCCACGCCTCCGCTGG CGACGCGACATTATTA CTTTTGGTACGCGCTG TGACACTTCAAACTCG TACCGTGAGTAATAAT GCGCCGTCCACGGCAC CGCATCGAAAACGC | 20 | mir-123/ mir-126as | CATTATTACTTTTGGTACGCG | 205 |
| mir-123/ mir-126 | GCCACGCCTCCGCTGG CGACGGGACATTATTA CTTTTGGTACGCGCTG TGACACTTCAAACTCG TACCGTGAGTAATAAT GCGCCGTCCACGGCAC CGCATCGAAAACGC | 20 | mir-126 | TCGTACCGTGAGTAATAATGC | 1076 |
| mir-132 | CGCGCCCCGCCCCCGC GTCTCCAGGGCAACCG TGGCTTTCGATTGTTA CTGTGGGAACTGGAGG TAACAGTCTACAGCCA TGGTCGCCCCGCAGCA CGCCCACGCGCCGC | 21 | miR-132 (RFAM- Human) | TAACAGTCTACAGCCATGGTCG | 1077 |
| mir-132 | CGCGCCCCGCCCCCGC GTCTCCAGGGCAACCG TGGCTTTCGATTGTTA CTGTGGGAACTGGAGG TAACAGTCTACAGCCA TGGTCGCCCCGCAGCA CGCCCACGCGCCGC | 21 | mir-132 | TAACAGTCTACAGCCATGGTCGC | 206 |
| mir-108_1 | GCTGCCCGATGCACAC TGCAAGAACAATAAGG ATTTTTAGGGGCATTA TGACTGAGTCAGAAAA CACAGCTGCCCCTGAA AGTCCCTCATTTTTCT TGCTGTCCTTGAAC | 22 | mir-108 | ATAAGGATTTTTAGGGGCATT | 207 |
| let-7i | ACACCATGGCCCTGGC TGAGGTAGTAGTTTGT GCTGTTGGTCGGGTTG TGACATTGCCCGCTGT GGAGATAACTGCGCAA GCTACTGCCTTGCTAG TGCTGGTGATGCTC | 24 | let-7i | TGAGGTAGTAGTTTGTGCT | 209 |
| let-7i | ACACCATGGCCCTGGC TGAGGTAGTAGTTTGT GCTGTTGGTCGGGTTG TGACATTGCCCGCTGT GGAGATAACTGCGCAA GCTACTGCCTTGCTAG TGCTGGTGATGCTC | 24 | let-7i Ruvkun | TGAGGTAGTAGTTTGTGCTGTT | 1078 |
| mir-212 | CGGGGCACCCCGCCCG GACAGCGCGCCGGCAC CTTGGCTCTAGACTGC TTACTGCCCGGGCCGC | 25 | mir-212 | TAACAGTCTCCAGTCACGGCC | 210 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CCTCAGTAACAGTCTC CAGTCACGGCCACCGA CGCCTGGCCCCGCC | | | | |
| hypo-thetical miRNA 023 | AGATTTAATTAGCTCA GAGAAGAAATGTTGCT TGGGCAAGAGGACTTT TTAATTATCAGCTTGG ATAAATTTGAAAATGT TGATGCCTAGGGGTTG AGTTAATTAAAACC | 26 | hypo-thetical miRNA-023 | TGGGCAAGAGGACTTTTTAAT | 1079 |
| mir-131_2/ mir-9 | GCCTGTGTGGGAAGCG AGTTGTTATCTTTGGT TATCTAGCTGTATGAG TGTATTGGTCTTCATA AAGCTAGATAACCGAA AGTAAAAACTCCTTCA AGATCGCCGGGGAG | 27 | mir-131 | TAAAGCTAGATAACCGAAAGT | 211 |
| mir-131_2/ mir-9 | GCCTGTGTGGGAAGCG AGTTGTTATCTTTGGT TATCTAGCTGTATGAG TGTATTGGTCTTCATA AAGCTAGATAACCGAA AGTAAAAACTCCTTCA AGATCGCCGGGGAG | 27 | mir-131_Ruvkun | TAAAGCTAGATAACCGAAAGTA | 1080 |
| mir-131_2/ mir-9 | GCCTGTGTGGGAAGCG AGTTGTTATCTTTGGT TATCTAGCTGTATGAG TGTATTGGTCTTCATA AAGCTAGATAACCGAA AGTAAAAACTCCTTCA AGATCGCCGGGGAG | 27 | miR-9 | TCTTTGGTTATCTAGCTGTATGA | 1081 |
| let-7b | GGCCGGGCCTGGCGGG GTGAGGTAGTAGGTTG TGTGGTTTCAGGGCAG TGATGTTGCCCCTCGG AAGATAACTATACAAC CTACTGCCTTCCCTGA GGAGCCCAGTGACA | 28 | let-7b | TGAGGTAGTAGGTTGTGTGGTT | 212 |
| let-7b | GGCCGGGCCTGGCGGG GTGAGGTAGTAGGTTG TGTGGTTTCAGGGCAG TGATGTTGCCCCTCGG AAGATAACTATACAAC CTACTGCCTTCCCTGA GGAGCCCAGTGACA | 28 | let-7b_Ruvkun | TGAGGTAGTAGGTTGTGTGGTTT | 1082 |
| mir-1d_1 | CTGCATGCAGACTGCC TGCTTGGGAAACATAC TTCTTTATATGCCCAT ATGGACCTGCTAAGCT ATGGAATGTAAAGAAG TATGTATCTCAGGCCG GGACCTCTCTCGCC | 29 | miR-1 (REAM) | TGGAATGTAAAGAAGTATGTA | 1083 |
| mir-1d_1 | CTGCATGCAGACTGCC TGCTTGGGAAACATAC TTCTTTATATGCCCAT ATGGACCTGCTAAGCT ATGGAATGTAAAGAAG TATGTATCTCAGGCCG GGACCTCTCTCGCC | 29 | mir-1d | TGGAATGTAAAGAAGTATGTAT | 213 |
| mir-122a | TGGCTACAGAGTTTCC TTAGCAGAGCTGTGGA GTGTGACAATGGTGTT TGTGTCTAAACTATCA AACGCCATTATCACAC | 30 | miR-122a,b (Tuschl) | TGGAGTGTGACAATGGTGTTTG | 1084 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TAAATAGCTACTGCTA GGCAATCCTTCCCT | | | | |
| mir-122a | TGGCTACAGAGTTTCC TTAGCAGAGCTGTGGA GTGTGACAATGGTGTT TGTGTCTAAACTATCA AACGCCATTATCACAC TAAATAGCTACTGCTA GGCAATCCTTCCCT | 30 | mir-122a | TGGAGTGTGACAATGGTGTTTGT | 214 |
| mir-22 | GCCCTCACCTGGCTGA GCCGCAGTAGTTCTTC AGTGGCAAGCTTTATG TCCTGACCCAGCTAAA GCTGCCAGTTGAAGAA CTGTTGCCCTCTGCCC CTGGCTTCGAGGAG | 31 | mir-22 | AAGCTGCCAGTTGAAGAACTGT | 215 |
| hypothetical miRNA 30 | CTACTGCTGTTGGTGG CAGCTTGGTGGTCGTA TGTGTGACGCCATTTA CTTGAACCTTTAGGAG TGACATCACATATACG GCAGCTAAACTGCTAC ATGGGACAACAATT | 33 | hypothetical miRNA-030 | TGACATCACATATACGGCAGC | 1085 |
| mir-142 | CGACGGACAGACAGAC AGTGCAGTCACCCATA AAGTAGAAAGCACTAC TAACAGCACTGGAGGG TGTAGTGTTTCCTACT TTATGGATGAGTGTAC TGTGGGCTTCGGAG | 34 | mir-142 | CATAAAGTAGAAAGCACTAC | 217 |
| mir-142 | CGACGGACAGACAGAC AGTGCAGTCACCCATA AAGTAGAAAGCACTAC TAACAGCACTGGAGGG TGTAGTGTTTCCTACT TTATGGATGAGTGTAC TGTGGGCTTCGGAG | 34 | miR-142-as | TGTAGTGTTTCCTACTTTATGG | 1086 |
| mir-142 | CGACGGACAGACAGAC AGTGCAGTCACCCATA AAGTAGAAAGCACTAC TAACAGCACTGGAGGG TGTAGTGTTTCCTACT TTATGGATGAGTGTAC TGTGGGCTTCGGAG | 34 | miR-142as (Michael et al) | TGTAGTGTTTCCTACTTTATGGA | 1087 |
| mir-183 | CCGCAGAGTGTGACTC CTGTTCTGTGTATCCC ACTGGTAGAATTCACT GTGAACAGTCTCAGTC AGTGAATTACCGAAGG GCCATAAACAGAGCAG AGACAGATCCACGA | 35 | mir-183 | TATGGCACTGGTAGAATTCACTG | 218 |
| mir-214 | GGCCTGGCTGGACAGA GTTGTCATGTGTCTGC CTGTCTACACTTGCTG TGCAGAACATCCGCTC ACCTGTACAGCACGCA CAGACAGGCAGTCACA TGACAACCCAGCCT | 37 | mir-214 | ACAGCAGGCACAGACAGGCAG | 219 |
| mir-143 | AGCAGCGCAGCGCCCT GTCTCCCAGCCTGAGG TGCAGTGCTCCATCTC TGGTCACTTGGCAGTC | 38 | miR-143 (Michael et al) | TGAGATGAAGCACTGTAGCTC | 1088 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TGAGATGAACCACTGT AGCTCAGGAAGAGAGA AGTTGTTCTGCAGC | | | | |
| mir-143 | AGCAGCGCAGCGCCCT GTCTCCCAGCCTGAGC TGCAGTGCTGCATCTC TGGTCAGTTGGGAGTC TGAGATGAAGCACTGT AGCTCAGCAAGAGAGA AGTTGTTCTGCAGC | 38 | mir-143 | TGAGATGAAGCACTGTAGCTCA | 220 |
| mir-192_1 | GCCGAGACCGAGTGCA CAGGGCTCTGACCTAT GAATTGACAGCCAGTG CTCTCGTCTCCCCTCT GGCTGCCAATTCCATA GGTCACAGGTATGTTC GCCTCAATGCCAGC | 39 | miR-192 (Tuschl) | CTGACCTATGAATTGACA | 1089 |
| mir-192_1 | GCCCAGACCGAGTGCA CAGGGCTCTGACCTAT GAATTGACAGCCAGTG CTCTCCTCTCCCCTCT GGCTGCCAATTCCATA GGTCACAGGTATCTTC GCCTCAATGCCAGC | 39 | mir-192 | CTGACCTATGAATTGACAGCC | 221 |
| mir-192_1 | GCCGAGACCGAGTGCA CAGGGCTCTGACCTAT GAATTGACAGCCAGTG CTCTCGTCTCCCCTCT GGCTGCCAATTCCATA GGTCACAGCTATGTTC GCCTCAATGCCAGC | 39 | miR-192 (Michael et al) | TGACCTATGAATTGACAGCCAG | 1090 |
| hypo- thetical miRNA 039 | CCCCTGTGCCTTCCGC GGGCGGCTGTTAAGAC TTGCAGTGATCTTTAA CTCCTCTCCACGTGAA CATCACAGCAAGTCTG TCCTGCTTCCCGTCCC TACGCTGCCTGGGC | 42 | hypo- thetical miRNA- 039 | TAAGACTTGCAGTCATGTTTA | 1091 |
| hypo- thetical miRNA 040 | CCCAGCAAATAATGGC TGTTGTATTAGCTGCT TTTGATGATAGTATGA AAGAAGTATTAGCACT TGTCAACAAAACTGCT TACAACATAACATTAG CATGCATGGGCTGC | 43 | hypo- thetical miRNA 040 | TGTCAACAAAACTGCTTACAA | 1092 |
| hypo- thetical miRNA 041 | CATACACGGCTGTTAC ACAGGTTTTCCCATGA TAAGGCAATAGGTTAA TGAAATGCTCATTTCA TTTTACCAGTTGTTTT CTCTGTGAAGTTCCGA TAAGTAGCAAACCA | 44 | hypo- thetical miRNA- 041 | TACCAGTTGTTTTCTCTGTGA | 1093 |
| let-7a_3 | CGACTGCCCTTTGGGG TGAGGTAGTAGGTTGT ATAGTTTGGGGCTCTG CCCTGCTATGGGATAA CTATACAATCTACTGT CTTTCCTGAAGTGGCT GTAATATCTGCGGT | 45 | let-7a | TGAGGTAGTAGGTTGTATAGTT | 222 |
| hypo- thetical miRNA 043 | CCCCTTATAGGCCCAT TTTGACAGGAAATCTT TGAGAGGCAGCAGCAA TGAAGTGCCCAGAGAT TTCATCTGTCTTCTTT | 46 | hypo- thetical miRNA- 043 | TGACAGGAAATCTTTGAGAGG | 1094 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TGCTTTAGGAAATGCT GAGCGCAAGGCTCC | | | | |
| hypothetical miRNA 044 | GCCTGAAATGAAATTA CCATATTTTAATCTT AATTTTCCACTCTGTT TATCTGACAGTGTGGA TGTGCAATCCAAACAG ATAATGAGAGAGTGGG ATATTGACACCGCT | 47 | hypothetical miRNA-044 | TTCCACTCTGTTTATCTGACA | 1095 |
| mir-181a_1 | AGAAGGGCTATCAGGC CAGCCTTCAGAGGACT CCAAGGAACATTCAAC GCTGTCGGTGAGTTTG GGATTTGAAAAAACCA CTGACCGTTGACTGTA CCTTGGGGTCCTTA | 48 | mir-178 (Kosik) | AACATTCAACGCTGTCGGTGAG | 1096 |
| mir-181a_1 | AGAAGGGCTATCAGGC CAGCCTTCAGAGGACT CCAAGGAACATTCAAC GCTGTCGGTGAGTTTG GGATTTGAAAAAACCA CTGACCGTTGACTGTA CCTTGGGGTCCTTA | 48 | mir-181a | AACATTCAACGCTGTCGGTGAGT | 223 |
| let-7a_1 | GTTCTCTTCACTGTGG GATGAGGTAGTAGGTT GTATAGTTTTAGGGTC ACACCCACCACTGGGA GATAACTATACAATCT ACTGTCTTTCCTAACG TGATAGAAAAGTCT | 49 | let-7a | TGAGGTAGTAGGTTGTATAGTT | 222 |
| mir-205 | AAAGATCCTCAGACAA TCCATGTGCTTCTCTT GTCCTTCATTCCACCG GAGTCTGTCTCATACC CAACCAGATTTCAGTG GAGTGAAGTTCAGGAG GCATGGAGCTGACA | 50 | mir-205 | TCCTTCATTCCACCGGAGTCTG | 224 |
| mir-33a | GGCCGCATACCTCCTG GCGGGCAGCTGTGGTG CATTGTAGTTGCATTG CATGTTCTGGTGGTAC CCATGCAATGTTTCCA CAGTGCATCACAGAGG CCTGCCTGGCCCTC | 53 | mir-33a | GTGCATTGTAGTTGCATTG | 227 |
| mir-196_2 | TGCTCGCTCAGCTGAT CTGTGGCTTAGGTAGT TTCATGTTGTTGGGAT TGAGTTTTGAACTCGG CAACAAGAAACTGCCT GAGTTACATCAGTCGG TTTTCGTCGAGCGC | 54 | miR-196 (Tuschl) | TAGGTAGTTTCATGTTGTTGG | 1097 |
| mir-196_2 | TGCTCGCTCAGCTGAT CTGTGGCTTAGGTAGT TTCATGTTGTTGGGAT TGAGTTTTGAACTCGG CAACAAGAAACTGCCT GAGTTACATCAGTCGG TTTTCGTCGAGGGC | 54 | mir-196 | TAGGTAGTTTCATGTTGTTGGG | 228 |
| let-7f_1 | ATTGCTCTATCAGAGT GAGGTAGTAGATTGTA TAGTTGTGGGGTAGTG ATTTTACCCTGTTCAG | 57 | let-7f (Michael et al) | TGAGGTAGTAGATTGTATAGT | 1098 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GAGATAACTATACAAT CTATTGCCTTCCCTGA GGAGTAGACTTGCT | | | | |
| let-7f_1 | ATTGCTCTATCAGAGT GAGGTAGTAGATTGTA TAGTTGTGGGGTAGTG ATTTTACCCTGTTCAG GAGATAACTATACAAT CTATTGCCTTCCCTGA GGAGTAGACTTGCT | 57 | let-7f | TGAGGTAGTAGATTGTATAGTT | 231 |
| hypothetical miRNA 055 | TTGAGCATGATGAATG ATTGGAGTCAGAGAAG CGGCGTGATAAATGGC AGCACCTTGGCTCCAT TGCATGCCCTATTGAT TCTCCTTCTTTATTAC TCCTACAACCCAGC | 58 | hypothetical miRNA-055 | TTGCATGCCCTATTGATTCTC | 1099 |
| mir-29c | ACCACTGGCCCATCTC TTACACAGGCTGACCG ATTTCTCCTGGTGTTC AGAGTCTGTTTTTGTC TAGCACCATTTGAAAT CGGTTATGATGTAGGG GGAAAAGCAGCAGC | 59 | mir-29c | CTAGCACCATTTGAAATCGGTT | 232 |
| mir-29c | ACCACTGGCCCATCTC TTACACAGGCTGACCG ATTTCTCCTGGTGTTC AGAGTCTGTTTTTGTC TAGCACCATTTGAAAT CGGTTATGATGTAGGG GGAAAAGCAGCAGC | 59 | miR-29c (Tuschl) | TAGCACCATTTGAAATCGGTTA | 1100 |
| mir-130a | CCGGCATGCCTCTGCT GCTGGCCAGAGCTCTT TTCACATTGTGCTACT GTCTGCACCTGTCACT AGCAGTGCAATGTTAA AAGGGCATTGGCCGTG TAGTGCTACCCAGC | 60 | mir-130a | CAGTGCAATGTTAAAAGGGC | 233 |
| mir-130a | CCGGCATGCCTCTGCT GCTGGCCAGAGCTCTT TTCACATTGTGCTACT GTCTGCACCTGTCACT AGCAGTGCAATGTTAA AAGGGCATTGGCCGTG TAGTGCTACCCAGC | 60 | mir-130 (Kosik) | CAGTGCAATGTTAAAAGGGCAT | 1101 |
| hypothetical miRNA 058 | TATCATCTTGTCAGAT GCTTAATGTTCTTCCT CCTGTCACTTTGGATA GGCCCAATTTGTAGAA TACTGCAGAGGTAAAA GAAGACAATTAACAGT GACAGGATGGTAAT | 61 | hypothetical miRNA-058 | TGTCAGATGCTTAATGTTCTT | 1102 |
| mir-218_1 | GTGATAATGTAGCGAG ATTTTCTGTTGTGCTT GATCTAACCATGTGGT TGCGAGGTATGAGTAA AACATGGTTCCGTCAA GCACCATGGAACGTCA CGCAGCTTTCTACA | 62 | mir-218 | TTGTGCTTGATCTAACCATGT | 234 |
| mir-218_1 | GTGATAATGTAGCGAG ATTTTCTGTTGTGCTT GATCTAACCATGTGGT TGCGAGGTATGAGTAA AACATGGTTCCGTCAA | 62 | mir-253* (Kosik) | TTGTGCTTGATCTAACCATGTG | 1103 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
|  | GCACCATGGAACGTCA CGCAGCTTTCTACA |  |  |  |  |
| mir-124a_2 | ATCAAGATTAGAGGCT CTGCTCTCCGTGTTCA CAGCGGACCTTGATTT AATGTCATACAATTAA GGCACGCGGTGAATGC CAAGAGCGGAGCCTAC GGGTGCACTTGAAG | 63 | mir-124a (Kosik) | TAAGGCACGCGGTGAATGCCA | 1104 |
| mir-124a_2 | ATCAAGATTAGAGGCT CTGCTCTCCGTGTTCA CAGCGGACCTTGATTT AATGTCATACAATTAA GGCACGCGGTGAATGC CAAGAGCGGAGCCTAC GGCTGCACTTGAAG | 63 | mir-124a | TTAAGGCACGCGGTGAATGCCA | 235 |
| mir-124a_2 | ATCAAGATTAGAGGCT CTGCTCTCCGTGTTCA CAGCGGACCTTGATTT AATGTCATACAATTAA GGCACGCGGTGAATGC CAAGAGCGGAGCCTAC GGCTGCACTTGAAG | 63 | mir-124a_Ruvkun | TTAAGGCACGCGGTGAATGCCAA | 1105 |
| mir-144 | TCCTGTGCCCCCAGTG GGGCCCTGGCTGGGAT ATCATCATATACTGTA AGTTTGCGATGAGACA CTACAGTATAGATGAT GTACTAGTCGGGGCAC CCCCAGCTCTGGAG | 66 | mir-144 | TACAGTATAGATGATGTACTAG | 237 |
| mir-221 | TGAACATCCAGGTCTG GGGCATGAACCTGGCA TACAATGTAGATTTCT GTGTTCGTTAGCCAAC AGCTACATTGTCTGCT GGGTTTCAGGCTACCT GGAAACATGTTCTC | 67 | mir-221 (RFAM-mmu) | AGCTACATTGTCTGCTGGGTTT | 1106 |
| mir-221 | TGAACATCCAGGTCTG GGGCATGAACCTGGCA TACAATGTAGATTTCT GTGTTCGTTAGCCAAC AGCTACATTGTCTGCT GGGTTTCAGGCTACCT GGAAACATGTTCTC | 67 | mir-221 | AGCTACATTGTCTGCTGGGTTTC | 238 |
| mir-222 | GCTGCTGGAAGGTGTA GGTACCCTCAATGGCT CAGTAGCCAGTGTAGA TCCTGTCTTTCGTAAT CAGCAGCTACATCTGG CTACTGGGTCTCTGAT GGCATCTTCTAGCT | 68 | mir-222 (RFAM-mmu) | AGCTACATCTGGCTACTGGGTCT | 1107 |
| mir-222 | GCTGCTGGAAGGTGTA GGTACCCTCAATGGCT CAGTAGCCAGTGTAGA TCCTGTCTTTCGTAAT CAGCAGCTACATCTGG CTACTGGGTCTCTGAT GGCATCTTCTAGCT | 68 | mir-222 | AGCTACATCTGGCTACTGGGTCTC | 239 |
| mir-30d | TCTTGTTCAGAAAGTC TGTTGTTGTAAACATC CCCGACTGGAAGCTGT AAGACACAGCTAAGCT | 69 | mir-30d | TGTAAACATCCCCGACTGGAAG | 240 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TTCAGTCAGATGTTTG CTGCTACCGGCTATTC ACAGACATCCTCTT | | | | |
| mir-30d | TCTTGTTCAGAAAGTC TGTTGTTGTAAACATC CCCGACTGGAAGCTGT AAGACACAGCTAAGCT TTCAGTCAGATGTTTG CTGCTACCGGCTATTC ACAGACATCCTCTT | 69 | mir-30d_Ruvkun | TGTAAACATCCCCGACTGGAAGCT | 1108 |
| mir-128b | GCCCGGCAGCCACTGT GCAGTGGGAAGGGGGG CCGATACACTGTACGA GAGTGAGTAGCAGGTC TCACAGTGAACCGGTC TCTTTCCCTACTGTGT CACACTCCTAATGG | 71 | mir-128 (Kosik) | TCACAGTGAACCGGTCTCTTT | 1073 |
| mir-128b | GCCCGGCAGCCACTGT GCAGTGGGAAGGGGGG CCGATACACTGTACGA GAGTGAGTAGCAGGTC TCACAGTGAACCGGTC TCTTTCCCTACTGTGT CACACTCCTAATGG | 71 | mir-128b | TCACAGTGAACCGGTCTCTTTC | 242 |
| mir-219_2 | GGGCCCTGAACTCAGG GGCTTCGCCACTGATT GTCCAAACGCAATTCT TGTACGAGTCTGCGGC CAACCGAGAATTGTGG CTGGACATCTGTGGCT GAGCTCCGGGCGCA | 72 | mir-219 | TGATTGTCCAAACGCAATTCT | 271 |
| hypo-thetical miRNA 070 | TTCGATGCTTGAAGAT GTCAGACTGTAGAATC TCTACGGGTAAGTGTC TGATTTCCTCAGTGAC ATCACATTTGCCTGCA GAGATTTTCCAGTCTG CCACTTTGAAGTTG | 73 | hypo-thetical miRNA-070 | TCACATTTGCCTGCAGAGATT | 1109 |
| mir-129_2 | GGCATATTCTGCCCTT CGCGAATCTTTTTGCG GTCTGGGCTTGCTGTA CATAACTCAATAGCCG GAAGCCCTTACCCCAA AAAGCATTTGCGGAGG GCGCACTCGTCGAG | 76 | mir-129as/ mir-258* (Kosik) | AAGCCCTTACCCCAAAAAGCAT | 1110 |
| mir-129_2 | GGCATATTCTGCCCTT CGCGAATCTTTTTGCG GTCTGGGCTTGCTGTA CATAACTCAATAGCCG GAAGCCCTTACCCCAA AAAGCATTTGCGGAGG GCGCACTCGTCGAG | 76 | mir-129 | CTTTTTGCGGTCTGGGCTTGC | 243 |
| mir-129_2 | GGCATATTCTGCCCTT CGCGAATCTTTTTGCG GTCTGGGCTTGCTGTA CATAACTCAATAGCCG GAAGCCCTTACCCCAA AAAGCATTTGCGGAGG GCGCACTCGTCGAG | 76 | miR-129b (RFAM-Human) | CTTTTTGCGGTCTGGGCTTGCT | 1111 |
| mir-133b | CAGAAGAAAGATGCCC CCTGCTCTGGCTGGTC AAACGGAACCAAGTCC GTCTTCCTGAGAGGTT TGGTCCCCTTCAACCA | 77 | mir-133b | TTGGTCCCCTTCAACCAGCTA | 244 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GCTACAGCAGGGCTGG CAATGCCCAGTCCT | | | | |
| hypo-thetical miRNA 075 | AGCGCAGCTTTAATTA CTCATGCTGCTGGTTA AAATATTAATGGGGCA CAGAGTGTTGCATGCT CATTTCTGTTGATTTT TAATTAGCAGTAATTC ATTTTGCACAAAGC | 78 | hypo-thetical miRNA-075 | TGGTTAAAATATTAATGGGGC | 1112 |
| let-7d | AAAAAAATGGGTTCCT AGGAAGAGGTAGTAGG TTGCATAGTTTTAGGG CAGGGATTTTGCCCAC AAGGAGGTAACTATAC GACCTGCTGCCTTTCT TAGGGCCTTATTAT | 79 | let-7d | AGAGGTAGTAGGTTGCATAGT | 245 |
| let-7d | AAAAAAATGGGTTCCT AGGAAGAGGTAGTAGG TTGCATAGTTTTAGGG CAGGGATTTTGCCCAC AAGGAGGTAACTATAC GACCTGCTGCCTTTCT TAGGGCCTTATTAT | 79 | let-7d_Ruvkun | AGAGGTAGTAGGTTGCATAGTT | 1113 |
| let-7d | AAAAAAATGGGTTCCT AGGAAGAGGTAGTAGG TTGCATAGTTTTAGGG CAGGGATTTTGCCCAC AAGGAGGTAACTATAC GACCTGCTGCCTTTCT TAGGGCCTTATTAT | 79 | let-7d* (RFAM-M.mu.) | CTATACGACCTGCTGCCTTTCT | 1114 |
| mir-15b | AATCCTACATTTTTGA GGCCTTAAAGTACTGT AGCAGCACATCATGGT TTACATGCTACAGTCA AGATGCGAATCATTAT TTGCTGCTCTAGAAAT TTAAGGAAATTCAT | 80 | miR-15b (Michael et al) | TAGCAGCACATCATGGTTTAC | 1115 |
| mir-15b | AATCCTACATTTTTGA GGCCTTAAAGTACTGT AGCAGCACATCATGGT TTACATGCTACAGTCA AGATGCGAATCATTAT TTGCTGCTCTAGAAAT TTAAGGAAATTCAT | 80 | mir-15b | TAGCAGCACATCATGGTTTACA | 246 |
| mir-29a | ACGACCTTCTGTGACC CCTTAGAGGATGACTG ATTTCTTTTGGTGTTC AGAGTCAATATAATTT TCTAGCACCATCTGAA ATCGGTTATAATGATT GGGGAAGAGCACCA | 81 | mir-29a | CTAGCACCATCTGAAATCGGTT | 247 |
| mir-29a | ACGACCTTCTGTGACC CCTTAGAGGATGACTG ATTTCTTTTGGTGTTC AGAGTCAATATAATTT TCTAGGACCATCTGAA ATCGGTTATAATGATT GGGGAAGAGCACCA | 81 | mir-29a_Ruvkun | TAGCACCATCTGAAATCGGTTA | 1116 |
| hypo-thetical miRNA 079 | CAAAGCTCTCCTGCCT GCTTCTGTGTGATATG TTTGATATTGGGTTGT TTAATTAGGAACCAAC | 82 | hypo-thetical miRNA-079 | TGATATGTTTGATATTGGG | 1117 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TAAATGTCAAACATAT TCTTACAGCAGCAGGT GATTCAGCACCACC | | | | |
| mir-199b | CCAGAGGACACCTCCA CTCCGTCTACCCAGTG TTTAGACTATCTGTTC AGGACTCCCAAATTGT ACAGTAGTCTGCACAT TGGTTAGGCTGGGCTG GGTTAGACCCTCGG | 83 | mir-199b (human) | CCCAGTGTTTAGACTATCTGTTC | 248 |
| mir-199b | CCAGAGGACACCTCCA CTCCGTCTACCCAGTG TTTAGACTATCTGTTC AGGACTCCCAAATTGT ACAGTAGTCTGCACAT TGGTTAGGCTGGGCTG GGTTAGACCCTCGG | 83 | miR-199-as | TACAGTAGTCTGCACATTGGTT | 1118 |
| mir-129_1 | GGATGGCTGCTGTCTC CTTTGGATCTTTTTGC GGTCTGGGCTTGCTGT TCCTCTCAACAGTAGT CAGGAAGCCCTTACCC CAAAAAGTATCTGCGG CAGGCCTTGTCCAC | 84 | mir-129 | CTTTTTGCGGTCTGGGCTTGC | 243 |
| mir-129_1 | GGATGGCTGCTGTCTC CTTTGGATCTTTTTGC GGTCTGGGCTTGCTGT TCCTCTCAACAGTAGT CAGGAAGCCCTTACCC CAAAAAGTATCTGCGG GAGGCCTTGTCCAC | 84 | miR-129b (RFAM-Human) | CTTTTTGCCGTCTGGGCTTGCT | 1111 |
| let-7e | ACCTGCCGCCCCCCCC GGGCTGAGGTAGGAGG TTGTATAGTTGAGGAG GACACCCAAGGAGATC ACTATACGGCCTCCTA GCTTTCCCCAGGCTGC GCCCTGCACGGGAC | 85 | let-7e | TGAGGTAGGACGTTGTATAGT | 249 |
| hypothetical miRNA 083 | TGGCAGGTTGTTTAGT TTTTTCGTTTGAAGGT TTTCATTAGTCTAATG AGGACTGTGCAAGGGC GAGCACTCAGCACAAT TTACATGGGGAAGCTA TCATAATAAATGAA | 86 | hypothetical miRNA-083 | TTACATGGGGAACCTATCATA | 1119 |
| let-7c_1 | ACCTGTGTGCATCCGG GTTGACGTAGTAGGTT GTATGGTTTAGAGTTA CACCCTGGGAGTTAAC TGTACAACCTTCTAGC TTTCCTTGGAGCACAC TTGAGCCGTCGAGG | 87 | let-7c | TGACGTAGTAGGTTGTATGGTT | 250 |
| let-7c_1 | AGCTGTGTGCATCCGG GTTGAGGTAGTAGGTT GTATGGTTTAGAGTTA CACCCTGCGAGTTAAC TGTACAACCTTCTAGC TTTCCTTGGAGCACAC TTGAGCCGTCGAGG | 87 | let-7c_Ruvkun | TGAGGTAGTAGGTTGTATGCTTT | 1120 |
| mir-204 | GGCTACAGTCTTTCTT CATGTGACTCGTGGAC TTCCCTTTGTCATCCT ATGCCTGAGAATATAT GAAGGAGGCTGGGAAG | 88 | mir-204 | TTCCCTTTGTCATCCTATGCCT | 251 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GCAAAGGGACGTTCAA TTGTCATCACTGGC | | | | |
| mir-204 | CGCTACAGTCTTTCTT CATGTGACTCGTGGAC TTCCCTTTGTCATCCT ATGCCTGAGAATATAT GAAGGAGGCTGGGAAG GCAAACGGACGTTCAA TTGTCATCACTGGC | 88 | miR-204 (Tuschl) | TTCCCTTTGTCATCCTATGCCTG | 1121 |
| mir-145 | CCACTCGCTCCCACCT TGTCCTCACGGTCCAG TTTTCCCAGGAATCCC TTAGATGCTAAGATGG GGATTCCTGGAAATAC TGTTCTTGAGGTCATG GTTTCACAGCTGGA | 89 | miR-145 (Michael et al) | GTCCAGTTTTCCCAGCAATCC | 1122 |
| mir-145 | CCACTCGCTCCCACCT TGTCCTCACGGTCCAG TTTTCCCAGGAATCCC TTAGATGCTAAGATGG GGATTCCTGGAAATAC TGTTCTTGAGGTCATG GTTTCACAGCTGGA | 89 | mir-145 | GTCCAGTTTTCCCAGGAATCCCTT | 252 |
| mir-124a_1 | TCCTTCCTCAGGAGAA AGGCCTCTCTCTCCGT GTTCACAGCGGACCTT GATTTAAATGTCCATA CAATTAAGGCACGCGG TGAATGCCAAGAATGG GGCTGGCTGAGCAC | 90 | mir-124a (Kosik) | TAAGGCACGCGGTGAATGCCA | 1104 |
| mir-124a_1 | TCCTTCCTCAGGAGAA AGGCCTCTCTCTCCGT GTTCACAGCGGACCTT GATTTAAATGTCCATA CAATTAAGGCACGCGG TGAATGCCAAGAATGG GGCTGGCTGAGCAC | 90 | mir-124a | TTAAGGCACGCGGTGAATGCCA | 235 |
| mir-124a_1 | TCCTTCCTCAGGAGAA AGGCCTCTCTCTCCGT GTTCACAGCGGACCTT GATTTAAATGTCCATA CAATTAAGGCACGCGG TGAATGCCAAGAATGG GGCTGGCTGAGCAC | 90 | mir-124a_Ruvkun | TTAAGGCACGCGGTGAATGCCAA | 1105 |
| DiGeorge syndrome critical region gene 8/ hypothetical miRNA-088 | AGTCGCCAGTCACTTA AGCTGAGTGCATTGTG ATTTCCAATAATTGAG GCAGTGGTTCTAAAAG CTGTCTACATTAATGA AAAGAGCAATGTGGCC AGCTTGACTAAGCC | 91 | hypothetical miRNA-088 | TGTGATTTCCAATAATTGAGG | 1123 |
| mir-213/ mir-181a2 | TGAGTTTTGAGGTTGC TTCAGTGAACATTCAA CGGTGTCGGTGAGTTT GGAATTAAAATCAAAA CCATCGACCGTTGATT GTACCCTATGGCTAAC CATCATCTACTCCA | 92 | mir-178 (Kosik) | AACATTCAACGCTGTCGGTGAG | 1096 |
| mir-213/ mir-181a2 | TGAGTTTTGAGGTTGC TTCAGTGAACATTCAA CGCTGTCGGTGAGTTT GGAATTAAAATCAAAA CCATCGACCGTTGATT | 92 | mir-181a | AACATTCAACGCTGTCGGTGAGT | 223 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTACCCTATGGCTAAC CATCATCTACTCCA | | | | |
| mir-213/ mir-181a_2 | TGAGTTTTGAGGTTGC TTCAGTGAACATTCAA CGCTGTCGGTGAGTTT GGAATTAAAATCAAAA CCATCGACCGTTGATT GTACCCTATGGCTAAC CATCATCTACTCCA | 92 | mir-213 | ACCATCGACCGTTGATTGTACC | 253 |
| hypo- thetical miRNA 090 | CAGCGATACATTAATG CTCATTTGGCTCTGCA AATCTTACCGTTTGCT TAGGCCAAATGGCGCA TCAATGACTATCGCTC TTACAAAGCTCTTGAA TCAGTATTATGTAA | 93 | hypo- thetical miRNA- 090 | TAGGCCAAATGGCGCATCAAT | 1124 |
| mir-20 | TATCTGATGTGACAGC TTCTGTAGCACTAAAG TGCTTATAGTGCAGGT AGTGTTTAGTTATCTA CTGCATTATGAGCACT TAAAGTACTGCTAGCT GTAGAACTCCAGCT | 94 | miR-20* (human) | ACTGCATTATGAGCACTTAAA | 1125 |
| mir-20 | TATCTGATGTGACAGC TTCTGTAGCACTAAAG TGCTTATAGTGCAGGT AGTGTTTAGTTATCTA CTGCATTATGAGCACT TAAAGTACTGCTAGCT GTAGAACTCCAGCT | 94 | miR-20 (RFAM- Human) | TAAAGTGCTTATAGTGCAGGTA | 1126 |
| mir-20 | TATCTGATGTGACAGC TTCTGTAGCACTAAAG TGCTTATAGTGCAGGT AGTGTTTAGTTATCTA CTGCATTATGAGCACT TAAAGTACTGCTAGCT GTAGAACTCCAGCT | 94 | mir-20 | TAAAGTGCTTATAGTGCAGGTAG | 254 |
| mir-133a_1 | CTAGCAGCACTACAAT GCTTTGCTAGAGCTGG TAAAATGGAACCAAAT CGCCTCTTCAATGGAT TTGGTCCCCTTGAACC AGCTGTAGCTATGCAT TGATTACTACGGGA | 95 | mir-133a | TTGGTCCCCTTCAACCAGCTGT | 255 |
| mir-138_2 | GCGGAGTTCTGGTATC GTTGCTGCAGCTGGTG TTGTGAATCAGGCCGA CGAGCAGCGCATCCTC TTACCCGGCTATTTCA CGACACCAGGGTTGCA TCATACCCATCCTC | 96 | mir-138 | AGCTGGTGTTGTGAATC | 256 |
| mir-138_2 | GCGGAGTTCTGGTATC GTTGCTGCAGCTGGTG TTGTGAATCAGGCCGA CGAGCAGCGCATCCTC TTACCCGGCTATTTCA CGACACCAGGGTTGCA TCATACCCATCCTC | 96 | mir- 138_Ruvkun | AGCTGGTGTTGTGAATCAGGCCG | 1127 |
| mir-196_1 | CTAGAGCTTGAATTGG AACTGCTGAGTGAATT AGGTAGTTTCATGTTG TTGGGCCTGGGTTTCT | 98 | miR-196 (Tuschl) | TAGGTAGTTTCATGTTGTTGG | 1097 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GAACACAACAACATTA AACCACCCGATTCACG GCAGTTACTGCTCC | | | | |
| mir-196_1 | CTAGAGCTTGAATTGG AACTGCTGAGTGAATT AGGTAGTTTCATGTTG TTGGGCCTGGGTTTCT GAACACAACAACATTA AACCACCCGATTCACG GCAGTTACTGCTCC | 98 | mir-196 | TAGGTAGTTTCATGTTGTTGGG | 228 |
| mir-125b_1 | AACATTGTTGCGCTCC TCTCAGTCCCTGAGAC CCTAACTTGTGATGTT TACCGTTTAAATCCAC GGGTTAGGCTCTTGGG AGCTGCGAGTCGTGCT TTTGCATCCTGGAA | 99 | mir-125b | TCCCTGAGACCCTAACTTGTGA | 258 |
| mir-199a_2 | AGGAAGCTTCTGGAGA TCCTGCTCCGTCGCCC CAGTGTTCAGACTACC TGTTCAGGACAATGCC GTTGTACAGTAGTCTG CACATTGGTTAGACTG GGCAAGGGAGAGCA | 100 | miR-199-s | CCCAGTGTTCAGACTACCTGTT | 1128 |
| mir-199a_2 | AGGAAGCTTCTGGAGA TCCTGCTCCGTCGCCC CAGTGTTCAGACTACC TGTTCAGGACAATGCC GTTGTACAGTAGTCTG CACATTGGTTAGACTG GGCAAGGGAGAGCA | 100 | mir-199a | CCCAGTGTTCAGACTACGTGTTC | 259 |
| mir-199a_2 | AGGAAGCTTCTGGAGA TCCTGCTCCGTCGCCC CAGTGTTCAGACTACC TGTTCAGGACAATGCC GTTGTACAGTAGTCTG CACATTGGTTAGACTG GGCAAGGGAGAGCA | 100 | miR-199-as | TACAGTAGTCTGCACATTGGTT | 1118 |
| hypo- thetical miRNA 099 | CTGGGGAGGTGAGCCT GAAAACAAAGGCAGAT AGAGAAGTCACAGCTC ACTGGTGAGGGAGCTA GAGAGTTGTTTTCTTA ATACCCTCTGCCTTTG AATCTGCCTAGATT | 102 | hypo- thetical miRNA- 099 | AGGCAGATAGAGAAGTCACAG | 1272 |
| mir-181b_1 | CCTGTGCAGAGATTAT TTTTTAAAAGGTCACA ATCAACATTCATTGCT GTCGGTGGGTTGAACT GTGTGGACAAGCTCAC TGAACAATGAATGCAA CTGTGGCCCCGCTT | 103 | mir-181b | AACATTCATTGCTGTCGGTGGGTT | 260 |
| hypo- thetical miRNA 101 | GTATATTCAGGGACAG GCCATTGACAGTCAAT TAACAAGTTTGATTGG TATGTCAACTCATTCT TTTGAATTGTTAATAG TATGTTAATAGCATTC GTTTCTTTGTGCAG | 104 | hypo- thetical miRNA- 101 | TGACAGTCAATTAACAAGTTT | 1130 |
| mir-141 | CTGTCGGCCGGCCCTG GGTCCATCTTCCAGTA CAGTGTTGGATGGTCT AATTGTGAAGCTCCTA ACACTGTCTGGTAAAG | 105 | mir-141 | AACACTGTCTGGTAAAGATGG | 261 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ATGGCTCCCGGGTGGG TTCTCTCGGCAGTA | | | | |
| mir-131_1/mir-9 | GCCAGAAGGCGGGGTT GGTTGTTATCTTTGGT TATCTAGCTGTATGAG TGGTGTGGAGTCTTCA TAAAGCTAGATAACCG AAAGTAAAAATAACCC CATACACTGCGCAG | 106 | mir-131 | TAAAGCTAGATAACCGAAAGT | 211 |
| mir-131_1/mir-9 | GCCAGGAGGCGGGGTT GGTTGTTATCTTTGGT TATCTAGCTGTATGAG TGGTGTGGAGTCTTCA TAAAGCTAGATAACCG AAAGTAAAAATAACCC CATACACTGCGCAG | 106 | mir-131_Ruvkun | TAAAGCTAGATAACCGAAAGTA | 1080 |
| mir-131_1/mir-9 | GCCAGGAGGCGGGGTT GGTTGTTATCTTTGGT TATCTAGCTGTATGAG TGGTGTGGAGTCTTCA TAAAGCTAGATAACCG AAAGTAAAAATAACCC CATACACTGCGCAG | 106 | miR-9 | TCTTTGGTTATCTAGCTGTATGA | 1081 |
| mir-133a_2 | TCGGATCTGGGAGCCA AATGCTTTGCTAGAGC TGGTAAAATGGAACCA AATCGACTGTCCAATG GATTTGGTCCCCTTCA ACCAGCTGTAGCTGTG CATTGATGGCGCCG | 107 | mir-133a | TTGGTCCCCTTCAACCAGCTGT | 255 |
| hypothetical miRNA 105 | CCGCCTCAGAGCCGCC CGCCGTTCCTTTTTCC TATGCATATACTTCTT TGAGGATCTGGCCTAA AGAGGTATAGGGCATG GGAAAACGGGGCGGTC GGGTCCTCCCCAGC | 108 | miR-202 (human) | AGAGGTATAGGGCATGGGAAAA | 1131 |
| hypothetical miRNA 105 | CCGCCTCAGAGCCGCC CGCCGTTCCTTTTTCC TATGCATATACTTCTT TGAGGATCTGGCCTAA AGAGGTATAGGGCATG GGAAAACGGGGCGGTC GGGTCCTCCCCAGC | 108 | hypothetical miRNA-105 | TTCCTATGCATATACTTCTTT | 1132 |
| hypothetical miRNA 107 | CTATAATGCTTAGATT ATCAATCATCTTGACA GTTTATTGGCTTTATC ACCACACATACCATTA AAATGATGTCTGGCCT AGACTGTCAGGAGCAA ACATTAAACACACC | 110 | hypothetical miRNA-107 | TGACAGTTTATTGGCTTTATC | 1133 |
| mir-1d_2 | ACAGCTAACAACTTAG TAATACCTACTCAGAG TACATACTTCTTTATG TACCCATATGAACATA CAATGCTATGGAATGT AAAGAAGTATGTATTT TTGGTAGGCAATAA | 111 | miR-1 (RFAM) | TGGAATGTAAAGAAGTATGTA | 1083 |
| mir-1d_2 | ACAGCTAACAACTTAG TAATACCTACTCAGAG TACATACTTCTTTATG TACCCATATGAACATA | 111 | mir-1d | TGGAATGTAAAGAAGTATGTAT | 213 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CAATGCTATGGAATGT AAAGAAGTATGTATTT TTGGTAGGCAATAA | | | | |
| mir-1d_2 | ACAGCTAACAACTTAG TAATACCTACTCAGAG TACATACTTCTTTATG TACCCATATGAACATA CAATGCTATGGAATGT AAAGAAGTATGTATTT TTGGTAGGCAATAA | 111 | miR-1d (Tuschl) | TGGAATGTAAAGAAGTATGTATT | 1134 |
| mir-220 | GACAGTGTGGCATTGT AGGGCTCCACACCGTA TCTGACACTTTGGGCG AGGGCACCATGCTGAA GGTGTTCATGATGCGG TCTGGGAACTCCTCAC GGATCTTACTGATG | 113 | mir-220 | CCACACCGTATCTGACACTTT | 263 |
| hypothetical miRNA 111 | CTCTGGCCTCCGCTTC CTCCTCCTCCGACTCG GACACCGGCGGAGCCT CCCCGCCCCGCGGAA GAAACCCCGAGCCTCG GCGGCGCAGGGAGTAG GAGAGCCCGGGGCT | 114 | hypothetical miRNA-111 | TTCCTCCTCCTCCGACTCGGA | 1135 |
| mir-73 | AGATTAGAGTGGCTGT GGTCTAGTGCTGTGTG GAAGACTAGTGATTTT GTTGTTCTGATGTACT ACGACAACAAGTCACA GCCGGCCTCATAGCGC AGACTCCCTTCGAC | 115 | mir-7 | TGGAAGACTAGTGATTTTGTT | 198 |
| mir-218_2 | GACCAGTCGCTGCGGG GCTTTCCTTTGTGCTT GATCTAACCATGTGGT GGAACGATGGAAACGG AACATGGTTCTGTCAA GCACCGCGGAAAGCAC CGTGCTCTCCTGCA | 116 | mir-218 | TTGTGCTTCATCTAACCATGT | 234 |
| mir-218_2 | GACCAGTCGCTGCGGG GCTTTCCTTTGTGCTT GATCTAACCATGTGGT GGAACGATGGAAACGG AACATGGTTCTGTCAA GCACCGCGGAAAGCAC CGTGCTCTCCTGCA | 116 | mir-253* (Kosik) | TTGTCCTTGATCTAACCATGTG | 1103 |
| mir-211 | TCACCTGGCCATGTGA CTTGTGGGCTTCCCTT TGTCATCCTTCGCCTA GGGCTCTGAGCAGGGC AGGGACAGCAAAGGGG TGCTCAGTTGTCACTT CCCACAGCACGGAG | 120 | mir-211 (human) | TTCCCTTTGTCATCCTTCGCCT | 1136 |
| mir-30b | CCAAGTTTCAGTTCAT GTAAACATCCTACACT CAGCTGTAATACATGG ATTGGCTGGGAGGTGG ATGTTTACTTCAGCTG ACTTGGAATGTCAACC AATTAACATTGATA | 122 | mir-30b | TGTAAACATCCTACACTCAGC | 266 |
| mir-30b | CCAAGTTTCAGTTCAT GTAAACATCCTACACT CAGCTGTAATACATGG ATTGGCTGGGAGGTGG ATGTTTACTTCAGCTG | 122 | mir-30b_Ruvkun | TGTAAACATCCTACACTCAGCT | 1137 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ACTTGGAATGTCAACC AATTAACATTGATA | | | | |
| hypothetical miRNA 120 | GGCTTCTTCCAGTCAT CCTGAGGTAGATATCA TCCAGGAATGCTGAGG CCTTATGGCTTACAGC AATCCAGTAATGATAT AAAAGGTGATTGGAGG TTAGATTTACATTG | 123 | hypothetical miRNA-120 | TTACAGCAATCCAGTAATGAT | 1138 |
| mir-10a | GATCTGTCTGTCTTCT GTATATACCCTGTAGA TCCGAATTTGTGTAAG GAATTTTGTGGTCACA AATTCGTATCTAGGGG AATATGTAGTTGACAT AAACACTCCGCTCT | 125 | mir-10a (Tuschl) | TACCCTGTAGATCCGAATTTGT | 1139 |
| mir-10a | GATCTGTCTGTCTTCT GTATATACCCTGTAGA TCCGAATTTGTGTAAG GAATTTTGTGGTCACA AATTCGTATCTAGGGG AATATGTAGTTGACAT AAACACTCCGCTCT | 125 | mir-10a | TACCCTGTAGATCCGAATTTGTG | 267 |
| let-7f_2 | ACACTGGTGCTCTGTG GGATGAGGTAGTAGAT TGTATAGTTTTAGGGT CATACCCCATCTTGGA GATAACTATACAGTCT ACTGTCTTTCCCACGG TGGTACACTTCTTC | 127 | let-7f (Michael et al) | TGAGGTAGTAGATTGTATAGT | 1098 |
| let-7f_2 | ACACTGGTGCTCTGTG GGATGAGGTAGTAGAT TGTATAGTTTTAGGGT CATACCCCATCTTGGA GATAACTATACAGTCT ACTGTCTTTCCCACGG TGGTACACTTCTTC | 127 | let-7f | TGAGGTAGTAGATTGTATAGTT | 231 |
| mir-108_2 | CCGAGGAATACTGCAA GAGCAATAAGGATTTT TAGGGGCATTATGATA GTGGAATGGAAACACA TCTGCCCCCAAAAGTC CCTCATTTTCCCTCGG GTAACGAACCAGCT | 129 | mir-108 | ATAAGGATTTTTAGGGGCATT | 207 |
| mir-137 | CTTGGTCCTCTGACTC TCTTCGGTGACGGGTA TTCTTGGGTGGATAAT ACGGATTACGTTGTTA TTGCTTAAGAATACGC GTAGTCGAGGAGAGTA CCAGCGGCAGGGGG | 130 | mir-137 | TATTGCTTAAGAATACGCGTAG | 270 |
| mir-148b | CATTTCCAAGCACGAT TAGCATTTGAGGTGAA GTTCTGTTATACACTC AGGCTGTGGCTCTCTG AAAGTCAGTGCATCAC AGAACTTTGTCTCGAA AGCTTTCTAGCAGC | 132 | mir-148b | TCAGTGCATCACAGAACTTTGT | 272 |
| mir-130b | GGGGAGGCACTGGCAG GCCTGCCCGACACTCT TTCCCTGTTGCACTAC TATAGGCCGCTGCGAA | 133 | mir-130b | CAGTGCAATGATGAAAGGGC | 273 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GCAGTGCAATGATGAA AGGGCATCGGTCAGGT CCAGCCTGCTACCC | | | | |
| mir-130b | GGGGAGGCACTGGCAG GCCTGCCCGACACTCT TTCCCTGTTGCACTAC TATAGGCCGCTGGGAA GCAGTGCAATGATGAA AGGGCATCGGTCAGGT CCAGCCTGCTACCC | 133 | mir-266* (Kosik) | CAGTGCAATGATGAAAGGGCAT | 1140 |
| let-7a_4 | TTGTGACTGCATGCTC CCAGGTTGAGGTAGTA GGTTGTATAGTTTAGA ATTACATCAAGGGAGA TAACTGTACAGCCTCC TAGCTTTCCTTGGGTC TTGCACTAAACAAC | 135 | let-7a | TGAGGTAGTAGGTTGTATAGTT | 222 |
| mir-216 | GATGGCTGTGAGTTGG CTTAATCTCAGCTGGC AACTGTGAGATGTTCA TACAATCCCTCACAGT GGTCTCTGGGATTATG CTAAACAGAGCAATTT CCTAGCCCTCACGA | 136 | mir-216 | TAATCTCAGCTGGCAACTGTG | 274 |
| hypothetical miRNA 137 | GTTCAACATAAGCAAA CAGATTGTAAACTGGC TGATAATTTTTGTACT GACAATGTCATTTACA GCTGTCAGCCTTTCGT CTGCCTTGTTTGCTTT ATTCAAATATGAAC | 140 | hypothetical miRNA-137 | TAAACTGGCTGATAATTTTTG | 1141 |
| hypothetical miRNA 138 | CCCTCCAATGTCTGAT TAATCAAGCCTGCAAA CAGCTTATTTCTTTTA GCCTGCATGCAAGTAT GAAAATGAGATTCTGG GAGCCGAACATGGTGC AGATTTGTTCATTC | 141 | hypothetical miRNA-138 | TGCAAGTATGAAAATGAGATT | 1142 |
| mir-124a_3 | CCCGCCCCAGCCCTGA GGGCCCCTCTGCGTGT TCACAGCGGACCTTGA TTTAATGTCTATACAA TTAAGGCACGCGGTGA ATGCCAAGAGAGGCGC CTCCGCCGCTCCTT | 143 | mir-124a (Kosik) | TAAGGCACGCGGTGAATGCCA | 1104 |
| mir-124a_3 | CCCGCCCCAGCCCTGA GGGCCCCTCTGCGTGT TCACAGCGGACCTTGA TTTAATGTCTATACAA TTAAGGCACGCGGTGA ATGCCAAGAGAGGCGC CTCCGCCGCTCCTT | 143 | mir-124a | TTAAGGCACGCGGTGAATGCCA | 235 |
| mir-124a_3 | CCCGCCCCAGCCCTGA GGGCCCCTCTGCGTGT TCACAGCGGACCTTGA TTTAATGTCTATACAA TTAAGGCACGCGGTGA ATGCCAAGAGAGGCGC CTCCGCCGCTCCTT | 143 | mir-124a_Ruvun | TTAAGGCACGCGGTGAATGCCAA | 1105 |
| mir-7_2 | CTGGATACAGAGTGGA CCGGCTGGCCCCATCT GGAAGACTAGTGATTT TGTTGTTGTCTTACTG CGCTCAACAACAAATC | 144 | mir-7 | TGGAAGACTAGTGATTTTGTT | 198 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CCAGTCTACCTAATGG TGCCAGCCATCGCA | | | | |
| hypothetical miRNA 142 | GGGGTGAATTTATTTC TTACAGAACCGCCCTG ATTCAGATGGTGCAAG CCTCGCAGGCCAGAAA CATCTTCCTGACGCTG CTCCCCACCTTCTGCC CTCTCTTTCCCAGC | 145 | hypothetical miRNA-142 | TGACGCTGCTCCCCACCTTCT | 1143 |
| hypothetical miRNA 143 | GCTGATGAAAATAGGG CAGTGGTTTAAATAGA TTTGCAAGCAATTTAC CTTTTCACAATGTTGG CAATCTGATGCAATTT GCTTGCAATTTTGTCT GCTTTCAGTAGCAC | 146 | hypothetical miRNA-143 | TGCAATTTGCTTGCAATTTTG | 1144 |
| mir-210 | ACCCdGCAGTGCCTCC AGGCGCAGGGCAGCCC CTGCCCACCGCACACT GCGCTGCCCCAGACCC ACTGTGCGTGTGACAG CGGCTGATCTGTGCCT GGGCAGCGCGACCC | 148 | mir-210 | CTGTGCGTGTGACAGCGGCTG | 277 |
| mir-215 | ATCATTCAGAAATGGT ATACAGGAAAATGACC TATGAATTGACAGACA ATATAGCTGAGTTTGT CTGTCATTTCTTTAGG CCAATATTCTGTATGA CTGTGCTACTTCAA | 149 | mir-215 | ATGACCTATGAATTGACAGAC | 278 |
| mir-223 | CCTGGCCTCCTGCAGT GCCACGCTCCGTGTAT TTGACAAGCTGAGTTG GACACTCCATGTGGTA GAGTGTCAGTTTGTCA AATACCCCAAGTGCGG CACATGCTTACCAG | 150 | mir-223 | TGTCAGTTTGTCAAATACCCC | 279 |
| mir-131_3/mir-9 | CACGGCGCGGCAGCGG CACTGGCTAAGGGAGG CCCGTTTCTCTCTTTG GTTATCTAGCTGTATG AGTGCCACAGAGCCGT CATAAAGCTAGATAAC CGAAAGTAGAAATG | 151 | mir-131 | TAAAGCTAGATAACCGAAAGT | 211 |
| mir-131_3/mir-9 | CACGGCGCGGCAGCGG CACTGGCTAAGGGAGG CCCGTTTCTCTCTTTG GTTATCTAGCTGTATG AGTGCCACAGAGCCGT CATAAAGCTAGATAAC CGAAAGTAGAAATG | 151 | mir-131_Ruvkun | TAAAGCTAGATAACCGAAAGTA | 1080 |
| mir-131_3/mir-9 | CACGGCGCGGCAGCGG CACTGGCTAAGGGAGG CCCGTTTCTCTCTTTG GTTATCTAGCTGTATG AGTGCCACAGACCCGT CATAAAGCTAGATAAC CCAAAGTAGAAATG | 151 | miR-9 | TCTTTCGTTATCTACCTGTATGA | 1081 |
| mir-199a_1 | TGGATAGCCGGCCCCG CCAACCCAGTGTTCAG ACTACCTGTTCAGGAG GCTCTCAATGTGTACA | 152 | miR-199-s | CCCAGTGTTCAGACTACCTGTT | 1128 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTAGTCTGCACATTGG<br>TTAGGCTGGGCTTGGG<br>TGAGCGGCTCGTCG | | | | |
| mir-199a_1 | TGGATAGCCGGCCCCG<br>CCAACCCAGTGTTCAG<br>ACTACCTGTTCAGGAG<br>GCTCTCAATGTGTACA<br>GTAGTCTGCACATTGG<br>TTAGGCTGGGCTTGCG<br>TGAGCGGCTCCTCG | 152 | mir-199a | CCCAGTGTTCAGACTACCTGTTC | 259 |
| mir-199a_1 | TGGATAGCCGGCCCCG<br>CCAACCCACTGTTCAG<br>ACTACCTGTTCAGGAG<br>GCTCTCAATGTGTACA<br>GTACTCTGCACATTGG<br>TTAGGCTGGGCTTGGG<br>TGAGCGGCTCGTCG | 152 | miR-199-as | TACAGTAGTCTGCACATTGGTT | 1118 |
| mir-30c_1 | CCTAGAGAGCACTGAG<br>CCACAGATACTGTAAA<br>CATCCTACACTCTCAG<br>CTCTCGAAAGTAAGAA<br>AGCTGGGAGAAGGCTG<br>TTTACTCTTTCTGCCT<br>TGGAAGTCAACTAA | 153 | mir-30c | TGTAAACATCCTACACTCTCAGC | 280 |
| mir-30c_1 | CCTAGAGAGCACTGAG<br>CGACAGATACTGTAAA<br>CATCCTACACTCTCAG<br>CTGTGGAAAGTAAGAA<br>AGCTGGGACAAGGCTG<br>TTTACTCTTTCTGCCT<br>TGGAAGTCAACTAA | 153 | mir-30c_Ruvkun | TGTAAACATCCTACACTCTCAGCT | 1129 |
| hypothetical miRNA 153 | TGTTGAATGCAAGCAG<br>ATGCTGATAATATCAG<br>AAGTCACAGCATAATT<br>TTTTTTGATCAAAGGC<br>CTCAAGTGAGCCTGAT<br>GAAGCATGCATCTTGC<br>TCGTCTTTGATAAA | 156 | hypothetical miRNA-153 | TGCAAGCAGATGCTGATAATA | 1145 |
| hypothetical miRNA 154 | CCTGCAGTGATGCTTC<br>ATGAGCAAATCACATG<br>ATGTCAGAATGGTATG<br>GTTTCGATTTAATCAA<br>GAAAGAGATTAAAGTG<br>GATGTGTGTTATTTTC<br>AACTTCGCAGCAGC | 157 | hypothetical miRNA-154 | TTAAAGTGGATGTGTGTTATT | 1146 |
| mir-26b | CGCCCCACCCTGCCCG<br>GGACCCAGTTCAAGTA<br>ATTCAGGATAGGTTGT<br>GTGCTGTCCAGCCTGT<br>TCTCCATTACTTGGCT<br>CGGGGACCGGTGCCCT<br>GCAGCCTTGGGGTG | 158 | miR-26b (RFAM-Human) | TTCAAGTAATTCAGGATAGGT | 1147 |
| mir-26b | CGCCCCACCCTGCCCG<br>GGACCCAGTTCAAGTA<br>ATTCAGGATAGGTTGT<br>GTGCTGTCCAGCCTGT<br>TCTCCATTACTTGGCT<br>CGGGGACCGGTGCCCT<br>GCAGCCTTGGGGTG | 158 | mir-26b | TTCAAGTAATTCAGGATAGGTT | 281 |
| hypothetical miRNA 156 | TGCGTTTACATAACAC<br>CAGGCGTGTGGGAGCT<br>GGAGGAAGAGGTTGCG<br>AATGTAGGAGAGATAA<br>GGCTCCTGCTTTCCCT | 159 | hypothetical miRNA-156 | TGCTTTCCCTCCTTCCTTCTT | 1148 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CCTTCCTTCTTGGTGG TACCAGGCTTGACA | | | | |
| mir-152 | GGCCCGCTGTCCCCCC CGGCCCAGGTTCTGTG ATACACTCCGACTCGG GCTCTGGAGCAGTCAG TGCATGACAGAACTTG GGCCCGGAAGGACCTT CTGCACCCAACGGG | 160 | mir-152 | TCAGTGCATGACAGAACTTGG | 282 |
| mir-135_1 | CAGCCCCAGGGCTCGC TGTTCTCTATGGCTTT TTATTCCTATGTGATT CTACTGCTCACTCATA TAGGGATTGGAGCCGT GGCGCACGGCGGGGAC AGCCAGCGGAGGGT | 161 | miR-135 (RFAM-Human) | TATGGCTTTTTATTCCTATGTGA | 1149 |
| mir-135_1 | CAGCCCCAGGCCTCGC TGTTCTCTATGGCTTT TTATTCCTATGTGATT CTACTGCTCACTCATA TAGGGATTGGAGCCGT GGCGCACGGCGGGGAC AGCCAGCGGAGGGT | 161 | mir-135 | TATGGCTTTTTATTCCTATGTGAT | 283 |
| non-coding RNA in rhabdomyos arcoma/ mir-135_2 | ACCAAGATAAATTCAC TCTAGTGCTTTATGGC TTTTTATTCCTATGTG ATAGTAATAAAGTCTC ATGTAGGGATGGAAGC CATGAAATACATTGTG AAAAATGATCAACT | 162 | miR-135 (REAM-Human) | TATGGCTTTTTATTCCTATGTGA | 1149 |
| non-coding RNA in rhabdomyos arcoma/ mir-135_2 | ACCAAGATAAATTCAC TCTAGTGCTTTATGGC TTTTTATTCCTATGTG ATAGTAATAAAGTCTC ATGTAGGGATGGAAGC CATGAAATACATTGTG AAAAATCATCAACT | 162 | mir-135 | TATGGCTTTTTATTCCTATGTGAT | 283 |
| mir-217 | AGTATAATTATTACAT AGTTTTTGATGTCGCA GATACTGCATCAGGAA CTGATTGGATAAGAAT CAGTCACCATCAGTTC CTAATGCATTGCCTTC AGCATCTAAACAAG | 163 | mir-217 (human) | TACTGCATCAGGAACTGATTGGAT | 284 |
| hypothetical miRNA 161 | CTTGGCCATAAACTTG TAGTCATCCTCTATCC AATCATATTGTCTTGA GTAATTAAAATGATTA GCTTAATTAGCTTAAT TAACTAAATTTGACTA CAGGACATGGCCAT | 164 | hypothetical miRNA-161 | TGGCCATAAACTTGTAGTCAT | 1150 |
| mir-15a | GGCGCGAATGTGTGTT TAAAAAAAATAAAACC TTGGAGTAAAGTAGCA GCACATAATGGTTTGT GGATTTTGAAAGGTG CAGGCCATATTGTGCT GCCTCAAAAATACA | 165 | mir-15_Ruvkun | TAGCAGCACATAATGGTTTGT | 1151 |
| mir-15a | GGCGCGAATGTGTGTT TAAAAAAAATAAAACC TTGGAGTAAAGTAGCA GCACATAATGGTTTGT | 165 | mir-15a | TAGCAGCACATAATGGTTTGTG | 269 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GGATTTTGAAAAGGTG CAGGCCATATTGTGCT GCCTCAAAAATACA | | | | |
| let-7g | TTTGCCTGATTCCAGG CTGAGGTAGTAGTTTG TACAGTTTGAGGGTCT ATGATACCACCCGGTA CAGGAGATAACTGTAC AGGCCACTGCCTTGCC AGGAACAGCGCGCC | 166 | let-7g | TGAGGTAGTAGTTTGTACAGT | 285 |
| let-7g | TTTGCCTGATTCCAGG CTGAGGTAGTAGTTTG TACAGTTTGAGGGTCT ATGATACCACCCGGTA CAGGAGATAACTGTAC AGGCCACTGCCTTGCC AGGAACAGCGCGCC | 166 | let-7gL_Ruvkun | TGAGGTAGTAGTTTGTACAGTT | 1152 |
| hypothetical miRNA 164 | AATTGTCCTTGGTTTT ACAATGATAAATGAAA AACATTAAAATTCTCC AACTGAACAGGTATGC AAGGATTTTTATGTTT TGTTGTTGTTGTTAAA ACAGTGAGAGCAAA | 167 | hypothetical miRNA-164 | TGCAAGGATTTTTATGTTTTG | 1153 |
| hypothetical miRNA 166 | GCAGTGGCGCTCAATG CTGTGCACTTCCAGTT GCAGCACCTGTAAGGT TTGTTAAAGGTAAAGG CAGGTCGGGAAAAGGT GCTTCGAGGAAGAGGC CTGGGAGGGGCGA | 169 | hypothetical miRNA-166 | TTCCAGTTGCAGCACCTGTAA | 1154 |
| hypothetical miRNA 168_1/similar to ribosomal protein L5 | ATGGACAAGATCTATG ACGGCCAAGTGGAGGT GACTGGCGATAAATAC AATGTGGAAAGTACTG ATGGTCAGCCAGGTGC CTTCACCTGCTGTATG GATGCAGGTCTTGC | 171 | hypothetical miRNA-168 | AGCCAGGTGCCTTCACCTGCT | 1155 |
| forkhead box P2/hypothetical miRNA-169 | CACTGGAGGCTGTTCT ATAAATGATCATTGAA GGGCTGCAAGCTAGCC TATAATTACAGGAAAG AAAGTGGCAGCTCTGG CATTTCATAACTATGT GTCCTCGAAAAGTG | 172 | hypothetical miRNA-169 | TGGCAGCTCTGGCATTTCATA | 1156 |
| hypothetical miRNA 170 | GAATGTATGATCTTGC TCTAACACTTGGCCAG ACCTGTGTCACCCACT GCTAGTGCCTGAAGTC GACAGACAATTCTGCC AAGGTAACCGAGAATC ATTAAGCATCCTGC | 173 | hypothetical miRNA-170 | TGATCTTGCTCTAACACTTGG | 1157 |
| glutamate receptor, ionotropic, AMPA 2/hypothetical miRNA-171 | CACCCTGTCTGACAAG TATGTTTTATCGTTTC AAGAAATGCGGTTAAC CTCGCAGTACTAAAAC TGAATGAACAAGGCCT GTTGGACAAATTGAAA AACAAATGGTGGTA | 174 | hypothetical miRNA-171 | TGACAAGTATGTTTTATCGTT | 1158 |
| hypothetical miRNA 172 | TGTTTTTTTGAGTACA TGTGTATAAATAGAGG TGGCTTCCTGTCAGTT TGGTATTATTGATATG ATCCAACTGCAAGAAG | 175 | hypothetical miRNA 172 | TCCAACTGCAAGAAGTTACT | 1159 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TTACTGCAACACTTTG CATCTTAAAGGTCC | | | | |
| hypothetical miRNA 173 | TAGTTCAGCACTCTTA CCTCTTATTGGTGTAC CACCTGGGTGGATAAT ATGAATGCAAATAAGA TTAGAAAGAAGAAGCA TTAGTACGAGAAGAAG GAGGCTAGGGCTGG | 176 | hypothetical miRNA-173 | TAGTACGAGAAGAAGGAGGCT | 1160 |
| mir-182 | GAGCTGCTTGCCTCCC CCCGTTTTTGGCAATG GTAGAACTCACACTGG TGAGGTAACAGGATCC GGTGGTTCTAGACTTG CCAACTATGGGGGGAG GACTCAGCCGGCAC | 177 | miR-182* (RFAM-Human) | TGGTTCTAGACTTGCCAACTA | 1161 |
| mir-182 | GAGCTGCTTGCCTCCC CCCGTTTTTGGCAATG GTAGAACTCACACTGG TGAGGTAACAGGATCC GGTGGTTCTAGACTTG CCAACTATGGGGCGAG GACTCAGCCGGCAC | 177 | mir-182 | TTTGGCAATGGTAGAACTCACA | 287 |
| hypothetical miRNA 175 | CTTGCCAGAAACATCA GTGACATGGACAAAGG TGTCATTGAAGGAGAG AAAGATGTGGCAGGCA CCAAATACATTGTCTC CTTCAACCACCTGAGG TCCGAGGCTGATGA | 178 | hypothetical miRNA-175 | TCTCCTTCAACCACCTGAGGT | 1162 |
| hypothetical miRNA 176 | TGGAAGGAAAATAGGA GTTTGATATGACATAT TGTGTGTCTCAGCAAG ACTCATAAATAATTTT GACAAGTTTTTGTATG CATGGGAAAGTCCTTG ATTCAGCCTCCCAT | 179 | hypothetical miRNA-176 | TAGGAGTTTGATATGACATAT | 1163 |
| hypothetical miRNA-177_1 | GGGAACCAGCGCTTTC AGTAAGAGAGTGGTAC CACGTGTCTTCAAAAT GAAACGTTTCTTGGAG ACAAACATGCTACTCT CACTGAGTACACAAGC TTCCTGGTTGTCAG | 180 | hypothetical miRNA-177 | AGACAAACATGCTACTCTCAC | 1164 |
| hypothetical miRNA 178 | CCAGTTTCCATCTGTC ATGATAGCCTATCTCC GAACCTTCAATCTGTC AAAAGCTCGCTGCCTG GCTGAAGGGTCCAGGA GATTTGGTGCACTAAA CACATTTGACAACA | 181 | hypothetical miRNA-178 | TAGCCTATCTCCGAACCTTCA | 1165 |
| hypothetical miRNA 179 | AATGCCAGTGAGTTTG AAAGGCACTTTGTCCA ATTAGAAGTGTGGAGA AATATTCATCCTGTCC ATGACAAAGATGAAGT GCTTCTTTCAAAAGCG GCGGTGGCAGGCTG | 182 | hypothetical miRNA-179 | TGAAAGGCACTTTGTCCAATT | 1166 |
| hypothetical mRNA 181 | TTGTGCACCTCACCTG CTCTGGAAGTAGTTTG CTAGCTCTGATGCTTC ATGGTTCAGACTCCTC AGGTGCACGATTAAAT | 184 | hypothetical miRNA-181 | TCACCTGCTCTGGAAGTAGTT | 1167 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TTCCAGAGTTGGTGAA CATGGCGCCACATG | | | | |
| mir-148a | GGAGGAAGACAGCACG TTTGGTCTTTTGAGGC AAAGTTCTGAGACACT CCGACTCTGAGTATGA TAGAAGTCAGTGCACT ACAGAACTTTGTCTCT AGAGGCTGTGGTCG | 185 | mir-148a | TCAGTGCACTACAGAACTTTGT | 288 |
| hypothetical miRNA 185 | ACACAAAACATGAACT GTGTACTCATTGTCTT CGCTGCACAGCTTGGC ATTGGGGTTGGTGACT CTGATGGCCAGCTGAG CAGCTCTTTCCACAAT GGCTTTGTGGTCCT | 188 | hypothetical miRNA-185 | TGATGGCCAGCTGAGCAGCTC | 1168 |
| hypothetical miRNA-177_2/ | ATATGGGAACCAGTGC TTGCAGAAAGAGGGTA GTTCCACATGTCTGCA | 189 | hypothetical miRNA 177 | AGACAAACATGCTACTCTCAC | 1164 |
| hypothetical miRNA 186 | AAACGAGACATCTCTT GAAGACAAACATGCTA CTCTCACTGCGTACAT AAGCTTCCTATTTG | | | | |
| mir-181c | CGGAAAATTTGCCAAG GGTTTGGGGAACATT CAACCTGTCGGTGAGT TTGGGCAGCTCAGGCA AACCATCGACCGTTGA GTGGACCCTGAGGCCT GGAATTGCCATCCT | 190 | mir-181c | AACATTCAACCTGTCGGTGAGT | 290 |
| hypothetical miRNA 188 | AGAATGGTATCATAGG ACAGTGTGATGGAATT TTTGTTTCTCTGTCAT CATTAAGGGGGTTCCC CCTATGGTGAGGGGAA TGAAAAGTACGATTTA ATGTTCTCTGGAGA | 191 | hypothetical miRNA-188 | TGGTGAGGGGAATGAAAAGTA | 1169 |
| mir-100_1 | CCTGTTGCCAGAAACC CGTAGATCCGAACTTG TGGTATTAGTCCGCAC AAGCTTGTATCTATAG GTATGTGTCTGTTAGG | 945 | mir-100 | AACCCGTAGATCCGAACTTGTG | 275 |
| mir-101_1 | TGCCCTGGCTCAGTTA TCACAGTGCTGATGCT GTCTATTCTAAAGGTA CAGTACTGTGATAACT GAAGGATGGCA | 946 | mir-101 | TACAGTACTGTGATAACTGA | 265 |
| mir-101_1 | TGCCCTGGCTCAGTTA TCACAGTGCTGATGCT GTCTATTCTAAAGGTA CAGTACTGTGATAACT GAAGGATGGCA | 946 | miR-101 (RFAM-Human) | TACAGTACTGTGATAACTGAAG | 1170 |
| mir-101_3 | TGTCCTTTTTCGGTTA TCATGGTACCGATGCT GTATATCTGAAAGGTA CAGTACTGTGATAACT GAAGAATGGTG | 947 | mir-101 | TACAGTACTGTGATAACTGA | 265 |
| mir-101_3 | TGTCCTTTTTCGGTTA TCATGGTACCGATGCT GTATATCTGAAAGGTA CAGTACTGTGATAACT GAAGAATGGTG | 947 | miR-101 (RFAM-Human) | TACAGTACTGTGATAACTGAAG | 1170 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-29b_2 | CTTCAGGAAGCTGGTTTCATATGGTGGTTTAGATTTAAATAGTGATTGTCTAGCACCATTTGAAATCAGTGTTCTTGGGGG | 948 | miR-29b (RFAM-Human) | TAGCACCATTTGAAATCAGT | 1172 |
| mir-29b_2 | CTTCAGGAAGCTGGTTTCATATGGTGGTTTAGATTTAAATAGTGATTGTCTAGCACCATTTGAAATCAGTGTTCTTGGGGG | 948 | miR-29b (RFAM-M.mu.) | TAGCACCATTTGAAATCAGTGT | 1173 |
| mir-29b_2 | CTTCAGGAAGCTGGTTTCATATGGTGGTTTAGATTTAAATAGTGATTGTCTAGCACCATTTGAAATCAGTGTTCTTGGGGG | 948 | mir-29b | TAGCACCATTTGAAATCAGTGTT | 195 |
| mir-29b_1 | CTTCTGGAAGCTGGTTTCACATGGTGGCTTAGATTTTTCCATCTTTGTATCTAGCACCATTTGAAATCAGTGTTTTAGGAG | 949 | miR-29b (RFAM-Human) | TAGCACCATTTGAAATCAGT | 1172 |
| mir-29b_1 | CTTCTGGAAGCTGGTTTCACATGGTGGCTTAGATTTTTCCATCTTTGTATCTAGCACCATTTGAAATCAGTGTTTTAGGAG | 949 | miR-29b (RFAM-M.mu.) | TAGCACCATTTGAAATCAGTGT | 1173 |
| mir-29b_1 | CTTCTGGAAGCTGGTTTCACATGGTGGCTTAGATTTTTCCATCTTTGTATCTAGCACCATTTGAAATCAGTGTTTTAGGAG | 949 | mir-29b | TAGCACCATTTGAAATCAGTGTT | 195 |
| mir-103_1 | TACTGCCCTCGGCTTCTTTACAGTGCTGCCTTGTTGCATATGGATCAAGCAGCATTGTACAGGGCTATGAAGGCATTG | 950 | mir-103 | AGCAGCATTGTACAGGGCTATGA | 225 |
| mir-106 | CCTTGGCCATGTAAAAGTGCTTACAGTGCAGGTAGCTTTTTGAGATCTACTGCAATGTAAGCACTTCTTACATTACCATGG | 951 | mir-106 (human) | AAAAGTGCTTACAGTGCAGGTAGC | 230 |
| mir-107 | CTCTCTGCTTTCAGCTTCTTTACAGTGTTGCCTTGTGGCATGGAGTTCAAGCAGCATTGTACAGGGCTATCAAAGCACAGA | 952 | mir-107 | AGCAGCATTGTACAGGGCTATCA | 229 |
| mir-16_1 | GCAGTGCCTTAGCAGCACGTAAATATTGGCGTTAAGATTCTAAAATTATCTCCAGTATTAACTGTGCTGCTGAAGTAAGGT | 953 | mir-16 | TAGCAGCACGTAAATATTGGCG | 196 |
| mir-16_1 | GCAGTGCCTTAGCAGCACGTAAATATTGGCGTTAAGATTCTAAAATTA | 953 | mir-16_Ruvkun | TAGCAGCACGTAAATATTGGCGT | 1176 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TCTCCAGTATTAACTG TGCTGCTGAAGTAAGG T | | | | |
| mir-16_3 | GTTCCACTCTAGCAGC ACGTAAATATTGGCGT AGTGAAATATATATTA AACACCAATATTACTG TGCTGCTTTAGTGTGA C | 954 | mir-16 | TAGCAGCACGTAAATATTGGCG | 196 |
| mir-16_3 | GTTCCACTCTAGCAGC ACGTAAATATTGGCGT AGTGAAATATATATTA AACACCAATATTACTG TGCTGCTTTAGTGTGA C | 954 | mir-16_Ruvkun | TAGCAGCACGTAAATATTGGCGT | 1176 |
| mir-18 | TTTTTGTTCTAAGGTG CATCTAGTGCAGATAG TGAAGTAGATTAGCAT CTACTGCCCTAAGTGC TCCTTCTGGCATAAGA A | 955 | mir-18 | TAAGGTGCATCTAGTGCAGATA | 262 |
| mir-18 | TTTTTGTTCTAAGGTG CATCTAGTGCAGATAG TGAAGTAGATTAGCAT CTACTGCCCTAAGTGC TCCTTCTGGCATAAGA A | 955 | mir-18_Ruvkun | TAAGGTGCATCTAGTGCAGATAG | 1177 |
| mir-19a | CAGTCCTCTGTTAGTT TTGCATAGTTGCACTA CAAGAAGAATGTAGTT GTGCAAATCTATGCAA AACTGATGGTGGCCTG | 956 | mir-19a | TGTGCAAATCTATGCAAAACTGA | 268 |
| mir-19b_1 | TTCTATGGTTAGTTTT GCAGGTTTGCATCCAG CTGTGTGATATTCTGC TGTGCAAATCCATGCA AAACTGACTGTGGTAG | 957 | mir-19b* (Michael et al) | AGTTTTGCAGGTTTGCATCCAGC | 1179 |
| mir-19b_1 | TTCTATGGTTAGTTTT GCAGGTTTGCATCCAG CTGTGTGATATTCTGC TGTGCAAATCCATGCA AAACTGACTGTGGTAG | 957 | mir-19b | TGTGCAAATCCATGCAAAACTGA | 241 |
| mir-19b_2 | TTACAATTAGTTTTGC AGGTTTGCATTTCAGC GTATATATGTATATGT GGCTGTGCAAATCCAT GCAAAACTGATTGTGA T | 958 | mir-19b | TGTGCAAATCCATGCAAAACTGA | 241 |
| mir-21 | ACCTTGTCGGGTAGCT TATCAGACTGATGTTG ACTGTTGAATCTCATG GCAACACCAGTCGATG GGCTGTCTGACATTTT G | 959 | mir-21 | TAGCTTATCAGACTGATGTTGA | 236 |
| mir-23a | CCACGGCCGGCTGGGG TTCCTGGGGATGGGAT TTGCTTCCTGTCACAA ATCACATTGCCAGGGA TTTCCAACCGACCCTG A | 960 | mir-23a | ATCACATTGCCAGGGATTTCC | 289 |
| mir-24_2 | CCCTGGGCTCTGCCTC CCGTGCCTACTGAGCT | 961 | mir-24 | TGGCTCAGTTCAGCAGGAACAG | 264 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GAAACACAGTTGGTTT GTGTACACTGGCTCAG TTCAGCAGGAACAGGG G | | | | |
| mir-17/mir-91 | TCAGAATAATGTCAAA GTGCTTACAGTGCAGG TAGTGATATGTGCATC TACTGCAGTGAAGGCA CTTGTAGCATTATGGT GA | 962 | mir-17 (human, rat) | ACTGCAGTGAAGGCACTTGT | 1180 |
| mir-17/mir-91 | TCAGAATAATGTCAAA GTGCTTACAGTGCAGG TAGTGATATGTGCATC TACTGCAGTGAAGGCA CTTGTAGCATTATGGT GA | 962 | mir-91_Ruvkun | CAAAGTGCTTACAGTGCAGGTAG | 1181 |
| mir-17/mir-91 | TCAGAATAATGTCAAA GTGCTTACAGTGCAGG TAGTGATATGTGCATC TACTGCAGTGAAGGCA CTTGTAGCATTATGGT GA | 962 | mir-17 as/mir-91 | CAAAGTGCTTACAGTGCAGGTAGT | 204 |
| mir-92_1 | CTTTCTACACAGGTTG GGATCGGTTGCAATGC TGTGTTTCTGTATGGT ATTGCACTTGTCCCGG CCTGTTGAGTTTGG | 963 | miR-92 (RFAM-M.mu.) | TATTGCACTTGTCCCGGCCTG | 1182 |
| mir-92_1 | CTTTCTACACAGGTTG GGATCGGTTGCAATGC TGTGTTTCTGTATGGT ATTGCACTTGTCCCGG CCTGTTGAGTTTGG | 963 | mir-92 | TATTGCACTTGTCCCGGCCTGT | 216 |
| mir-96 | TGGCCGATTTTGGCAC TAGCACATTTTTGCTT GTGTCTCTCCGCTCTG AGCAATCATGTGCAGT GCCAATATGGGAAA | 964 | mir-96 | TTTGGCACTAGCACATTTTTGC | 203 |
| mir-96 | TGGCCGATTTTGGCAC TAGCACATTTTTGCTT GTGTCTCTCCGCTCTG AGCAATCATGTGCAGT GCCAATATGGGAAA | 964 | miR-96 (RFAM-M.mu.) | TTTGGCACTAGCACATTTTTGCT | 1183 |
| mir-30a | GTGAGCGACTGTAAAC ATCCTCGACTGGAAGC TGTGAAGCCACAGATG GGCTTTCAGTCGGATG TTTGCAGCTGCCTACT | 965 | mir-30a | CTTTCAGTCGGATGTTTGCAGC | 193 |
| mir-30a | GTGAGCGACTGTAAAC ATCCTCGACTGGAAGC TGTGAAGCCACAGATG GGCTTTCAGTCGGATG TTTGCAGCTGCCTACT | 965 | miR-30a-s | TGTAAACATCCTCGACTGGAAGC | 1184 |
| mir-98 | GTGAGGTAGTAAGTTG TATTGTTGTGGGGTAG GGATATTAGGCCCCAA TTAGAAGATAACTATA CAACTTACTACTTTCC | 966 | mir-98 | TGAGGTAGTAAGTTGTATTGTT | 257 |
| mir-104 (Mourelatos) | AAATGTCAGACAGCCC ATCGACTGGTGTTGCC ATGAGATTCAACAGTC AACATCAGTCTGATAA GCTACCCGACAAGG | 967 | miR-104 (Mourelatos) | TCAACATCAGTCTGATAAGCTA | 335 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-105 (Mourelatos) | TGTGCATCGTGGTCAAATGCTCAGACTCCTGTGGTGGCTGCTCATGCACCACGGATGTTTGAGCATGTGCTACGGTGTCTA | 968 | miR-105 (Mourelatos) | TCAAATGCTCAGACTCCTGT | 1185 |
| mir-27 (Mourelatos) | CCTGAGGAGCAGGGCTTAGCTGCTTGTGAGCAGGGTCCACACCAAGTCGTGTTCACAGTGGCTAAGTTCCGCCCCCCAGG | 969 | miR-27 (Mourelatos) | TTCACAGTGGCTAAGTTCC | 1186 |
| mir-27 (Mourelatos) | CCTGAGGAGCAGGGCTTAGCTGCTTGTGAGCAGGGTCCACACCAAGTCGTGTTCACAGTGGCTAAGTTCCGCCCCCCAGG | 969 | miR-27a (RFAM-M.mu.) | TTCACAGTGGCTAAGTTCCGC | 1187 |
| mir-27 (Mourelatos) | CCTGAGGAGCAGGGCTTAGCTGCTTGTGAGCAGGGTCCACACCAAGTCGTGTTCACAGTGGCTAAGTTCCGCCCCCCAGG | 969 | miR-27a (RFAM-Human) | TTCACAGTGGCTAAGTTCCGCC | 1188 |
| mir-92_2 | TCATCCCTGGGTGGGGATTTGTTGCATTACTTGTGTTCTATATAAAGTATTGCACTTGTCCCGGCCTGTGGAAGA | 970 | miR-92 (RFAM-M.mu.) | TATTGCACTTGTCCCGGCCTG | 1182 |
| mir-92_2 | TCATCCCTGGGTGGGGATTTGTTGCATTACTTGTGTTCTATATAAAGTATTGCACTTGTCCCGGCCTGTGGAAGA | 970 | mir-92 | TATTGCACTTGTCCCGGCCTGT | 216 |
| mir-93 (Mourelatos) | CTGGGGGCTCCAAAGTGCTGTTCGTGCAGGTAGTGTGATTACCCAACCTACTGCTGAGCTAGCACTTCCCGAGCCCCCGG | 971 | miR-93 (Mourelatos) | AAAGTGCTGTTCGTGCAGGTAG | 1189 |
| mir-93 (Mourelatos) | CTGGGGGCTCCAAAGTGCTGTTCGTGCAGGTAGTGTGATTACCCAACCTACTGCTGAGCTAGCACTTCCCGAGCCCCCGG | 971 | miR-93 (Tuschl) | CAAAGTGCTGTTCGTGC | 1190 |
| mir-93 (Mourelatos) | CTGGGGGCTCCAAAGTGCTGTTCGTGCAGGTAGTGTGATTACCCAACCTACTGCTGAGCTAGCACTTCCCGAGCCCCCGG | 971 | miR-93 (RFAM-M.mu.) | CAAAGTGCTGTTCGTGCAGGTAG | 1191 |
| mir-95 (Mourelatos) | AACACAGTGGGCACTCAATAAATGTCTGTTGAATTGAAATGCGTTACATTCAACGGGTATTTATTGAGCACCCACTCTGTG | 972 | miR-95 (Mourelatos | TTCAACGGGTATTTATTGAGCA | 1192 |
| mir-99 (Mourelatos) | CCCATTGGCATAAACCCGTAGATCCGATCTTGTGGTGAAGTGGACCGCACAAGCTCGCTTCTATGGGTCTGTGTCAGTGTG | 973 | miR-99 (Mourelatos) | AACCCGTAGATCCGATCTTGTG | 1193 |
| mir-99 (Mourelatos) | CCCATTGGCATAAACCCGTAGATCCGATCTTGTGGTGAAGTGGACCGC | 973 | miR-99a (Tuschl) | ACCCGTAGATCCGATCTTGT | 1194 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-25 | ACAAGCTCGCTTCTAT GGGTCTGTGTCAGTGT G CTCCCTCACAGGACAG CTGAACTCCGGGACTG GCCAGTGTTGAGAGGC GGAGACTTGGGCAATT GCTGGACGCTGCCCTG GGCATTGCACTTGTCT CGGTCTGACAGTGCCG GCCCAACACTGCGGAT GCTGGGGGAGGGGG | 974 | miR-25 (Tuschl) | CATTGCACTTGTCTCGGTCTGA | 1195 |
| mir-28 | TTTAAAATGGTCCTTG CCCTCAAGGAGCTCAC AGTCTATTGAGTTACC TTTCTGACTTTCCCAC TAGATTGTGAGCTCCT GGAGGGCAGGCACTTT CGTTC | 975 | miR-28 (Tuschl) | AAGGACCTCACAGTCTATTGAG | 1196 |
| mir-31 | CTCCTGTAACTTGGAA CTGGAGAGGAGGCAAG ATGCTGGCATAGCTGT TGAACTGGGAACCTGC TATGCCAACATATTGC CATCTTTCCTGTCTGA CAGCAGCCAT | 976 | miR-31 (RFAM-M.mu.) | AGGCAAGATGCTGCCATAGCTG | 1197 |
| mir-31 | CTCCTGTAACTTGGAA CTGGAGAGGAGGCAAG ATGCTGGCATAGCTGT TGAACTGGGAACCTGC TATGCCAACATATTGC CATCTTTCCTGTCTGA CAGCAGCCAT | 976 | miR-31 (Tuschl) | GGCAAGATGCTGGCATAGCTG | 1198 |
| mir-32 | TTCTGCTTGCTCTGGT GGAGATATTGCACATT ACTAACTTGCATGTTG TCACGGCCTCAATGCA ATTTAGTGTGTGTGAT ATTTTCACATGAGTGC ATGCA | 977 | miR-32 (Tuschl) | TATTGCACATTACTAAGTTGC | 1199 |
| mir-149 | GGCCGGCGCCCGAGCT CTGGCTCCGTGTCTTC ACTCCCGTGCTTGTCC GAGGAGGGAGGGAGGG ACGGGGCTGTGCTGG GGCAGCTGGAACA | 978 | miR-149 | TCTGGCTCCGTGTCTTCACTCC | 1200 |
| mir-30c_2 | AACCATGCTGTAGTGT GTGTAAACATCCTACA CTCTCAGCTGTGAGCT CAAGGTGGCTGGGAGA GGGTTGTTTACTCCTT CTGCCATGGAAAACAT CAGCT | 979 | mir-30c | TGTAAACATCCTACACTCTCAGC | 280 |
| mir-30c_2 | AACCATGCTGTAGTGT GTGTAAACATCCTACA CTCTCAGCTGTGAGCT CAAGGTGGCTGGGAGA GGGTTGTTTACTCCTT CTGCCATGGAAAACAT CAGCT | 979 | mir-30c_Ruvkun | TGTAAACATCCTACACTCTCAGCT | 1129 |
| mir-99b | TCCTGGGTCCTGGCAC CCACCCGTAGAACCGA CCTTGCGGGGCTTCG CCGCACACAAGCTCGT GTCTGTGGGTCCGTGT CGGGGGCTCACCATCG | 980 | miR-99b | CACCCGTAGAACCGACCTTGCG | 1201 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| MiR-125a | TCTAGGTCCCTGAGACCCTTTAACCTGTGAGGACATCCAGGGTCACAGGTGAGGTTCTTGGGAGCCTGGCGT | 981 | miR-125a | TCCCTGAGACCCTTTAACCTCTG | 1202 |
| MiR-125b_2 | GACTTTTCCTAGTCCCTGAGACCCTAACTTGTGAGGTATTTTAGTAACATCACAAGTCAGGCTCTTGGGACCTAGGCGGAG | 982 | mir-125b | TCCCTGAGACCCTAACTTGTGA | 258 |
| mir-26a2 | CCCATAGAGGCTGTGGCTGGATTCAAGTAATCCAGGATAGGCTGTTTCCATCTGTGAGGCCTATTCTTGATTACTTGTTTCTGGAGGCAGCTGATGGTC | 983 | miR-26a (Michael et al) | TTCAAGTAATCCAGGATAGGC | 1203 |
| mir-26a2 | CCCATAGAGGCTGTGGCTGGATTCAAGTAATCCAGGATAGGCTGTTTCCATCTGTGAGGCCTATTCTTGATTACTTCTTTCTGGAGGCAGCTGATGGTC | 983 | mir-26a | TTCAAGTAATCCAGGATAGGCT | 226 |
| mir-127 | TCTCCAGCCTGCTGAAGCTCAGAGGGCTCTGATTCAGAAAGATCATCGGATCCGTCTGAGCTTGGCTGGTCGGAAGT | 984 | mir-127_Ruvkun | TCGGATCCGTCTGAGCTTGG | 1204 |
| mir-127 | TCTCCAGCCTGCTGAAGCTCAGAGGGCTCTGATTCAGAAAGATCATCGGATCCGTCTCAGCTTGGCTGGTCGGAAGT | 984 | miR-127 | TCGGATCCGTCTGAGCTTGGCT | 1205 |
| mir-136 | TGGATGAGCCCTCGGAGGACTCCATTTGTTTTGATGATGGATTCTTATGCTCCATCATCGTCTCAAATGAGTCTTCAGAGGGTTCTATCAT | 985 | miR-136 | ACTCCATTTGTTTTGATGATGGA | 1206 |
| mir-154 | GTGGTACTTGAAGATAGGTTATCCGTGTTGCCTTCGCTTTATTTGTGACGAATCATACACGGTTGACCTATTTTTCAGTACCAA | 986 | miR-154 | TAGGTTATCCGTGTTGCCTTCG | 1207 |
| mir-26a_1 | CCGTGGCCTCGTTCAAGTAATCCAGGATAGGCTGTGCAGGTCCCAATGGGCCTATTCTTGGTTACTTGCACGGGGACGCGG | 987 | miR-26a (Michael et al) | TTCAAGTAATCCAGGATAGGC | 1203 |
| mir-26a_1 | CCGTGGCCTCGTTCAAGTAATCCAGGATAGGCTGTGCAGGTCCCAATGGGCCTATTCTTGGTTACTTGCACGGGGACGCGG | 987 | mir-26a | TTCAAGTAATCCAGGATAGGCT | 226 |
| mir_186 | ATTGCTTGTAACTTTCCAAAGAATTCTCCTTTTCGGCTTTCTGGTTTT | 988 | miR-186 | CAAAGAATTCTCCTTTTGGGCTT | 1208 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ATTTTAAGCCCAAAGG TGAATTTTTTGGGAAG TTTGAGCT | | | | |
| mir_198 | GGTTCTGATCATTGGT CCAGAGGGGAGATAGG TTCCTGTGATTTTTCC TTCTTCTCTATAGAAT A | 989 | mir-198 | GGTCCAGAGGGGAGATAGG | 1209 |
| mir_191 | CGCCAACGGCTGGACA GCCGGCAACGGAATCC CAAAAGCAGCTGTTGT CTCCAGAGCATTCCAG CTGCGCTTGGATTTCG TCCCCTGCTCTCCTGC CTGAGC | 990 | mir-191 | CAACGGAATCCCAAAAGCAGCT | 1210 |
| mir_191 | CGCCAACGGCTGGACA GCGGGCAACGGAATCC CAAAAGCAGCTGTTGT CTCCAGAGCATTCCAG CTGCGCTTGGATTTCG TCCCCTGCTCTCCTGC CTGAGC | 990 | mir-191_Ruvkun | CAACGGAATCCCAAAAGCAGCTGT | 1211 |
| mir_206 | GCTTCCCGAGGCCACA TGCTTCTTTATATCCC CATATGGATTACTTTG CTATGGAATGTAAGGA ACTGTGTGGTTTCGGC AAGT | 991 | mir-206 | TGGAATGTAAGGAAGTGTGTGG | 1212 |
| mir-94/mir-106b | ACCCCTGCCGGGGCTA AAGTGCTGACAGTGCA GATAGTGGTCCTCTCC GTGCTACCGCACTGTG GGTACTTGCTGCTCCA GCAGGGCA | 992 | miR-94 | AAAGTGCTGACAGTGCAGAT | 1213 |
| mir-94/mir-106b | AGCCCTGCCGGGGCTA AAGTGCTGACAGTGCA GATAGTGGTCCTCTCC GTCCTACCGCACTGTG GGTACTTGCTGCTCCA GCAGGGCA | 992 | miR-106b (RFAM-M.mu.) | TAAAGTGCTGACAGTGCACAT | 1214 |
| mir_184 | CCAGTCACGTCCCCTT ATCACTTTTCCAGCCC AGCTTTGTGACTGTAA GTGTTGGACGGAGAAC TGATAAGGGTAGGTGA TTGAC | 993 | miR-184 | TGGACGGAGAACTGATAAGGGT | 1215 |
| mir_195 | AGCTTCCCTGGCTCTA GCAGCACAGAAATATT GGCACAGGGAAGCGAG TCTGCCAATATTGGCT GTGCTGCTCCAGGCAG GGTGGTG | 994 | miR-195 | TAGCAGCACAGAAATATTGGC | 1216 |
| mir_193 | ATGCGAGCTGAGGCCT GGGTCTTTGCGGGCGA GATGAGGGTGTCGGAT CAACTGGCCTACAAAG TCCCAGTTCTCGGCCC CC | 995 | miR-193 | AACTGCCCTACAAAGTCCCAG | 1217 |
| mir_185 | AGGGGGCGAGGGATTG GAGAGAAAGGCAGTTC CTGATGGTCCCCTCCC CAGGGGCTGGCTTTCC | 996 | miR-185 | TGGAGAGAAAGGCAGTTC | 1218 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TCTGGTCCTTCCCTCCCA | | | | |
| mir_188 | TCCCTGCTCCCTCTCTCACATCCCTTGCATGGTGGAGGGTGAGCTTTCTGAAAACCCCTCCCACATGCAGGGTTTGCAGGATGGCGAGCCT | 997 | miR-188 | CATCCCTTGCATGGTGGAGGGT | 1219 |
| mir_197 | GGGGCTGTGCCGGGTAGAGAGGGCAGTGGGAGGTAAGAGCTCTTCACCCTTCACCACCTTCTCCACCCAGCATGGCCG | 998 | miR-197a | TTCACCACCTTCTCCACCCAGC | 1220 |
| mir_194_1 | CTTATATGTTTAATGGTGTTATCAAGTGTAACAGCAACTCCATGTGGACTGTGTACCAATTTCCAGTGGACATGCTGTTACTTTTGATGGTTACCAACTTGCTACAATATAAA | 999 | miR-194 | TGTAACAGCAACTCCATGTGGA | 1221 |
| mir_208 | TTCCTGTGACGGGCGAGCTTTTGGCCCGGGTTATACCTGATGCTCACGTATAAGACGAGCAAAAAGCTTGTTGGTCAGAGGAG | 1000 | miR-208 | ATAAGACGAGCAAAAAGCTTGT | 1222 |
| mir_194_2 | AATTGGTTCCCGCCCCCTGTAACAGCAACTCCATGTGGAAGTGCCCACTGGTTCCAGTGGGGCTGCTGTTATCTGGGGCGAGGGCCAGTAC | 1001 | miR-194 | TGTAACAGCAACTCCATGTGGA | 1221 |
| mir_139 | GGGACTGGCTCAGGTGTATTCTACAGTGCACGTGTCTCCAGTGTGGCTCGGAGGCTGGAGACGCGGCCCTGTTGGAGTAACAACTGAAGCCGGAGTCT | 1002 | miR-139 | TCTACAGTGCACGTGTCT | 1223 |
| mir-200b | GTGGCCATCTTACTGGGCAGCATTGGATGGAGTCAGGTCTCTAATACTGCCTGGTAATGATGACGGCGGAG | 1003 | miR-200a (RFAM-Human) | CTCTAATACTGCCTGGTAATGATG | 1224 |
| mir-200b | GTGGCCATCTTACTGGGCAGCATTGGATGGAGTCAGGTCTCTAATACTGCCTGGTAATGATGACGGCGGAG | 1003 | miR-200b (Michael et al) | TAATACTGCCTGGTAATGATGA | 1225 |
| mir-200b | GTGGCCATCTTACTGGGCAGCATTGGATGGAGTCAGGTCTCTAATACTGCCTGGTAATGATGACGGCGGAG | 1003 | miR-200b | TAATACTGCCTGGTAATGATGAC | 1226 |
| mir-200a | CGGGCCCCTGTGAGCATCTTACCGGACAGTGCTGGATTTCCCAGCTTGACTCTAACACTGTCTGGTAACGATGTTCAAAGGTGACCCGC | 1004 | miR-200a | TAACACTGTCTGGTAACGATG | 1227 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-200a | CGGGCCCCTGTGAGCATCTTACCGGACAGTGCTGGATTTCCCAGCTTGACTCTAACACTGTCTGGTAACGATGTTCAAAGGTGACCCGC | 1004 | miR-200a (RFAM-M.mu.) | TAACACTGTCTGGTAACGATGT | 1228 |
| mir-240* (Kosik) | TTGAGCGGGGGTCAAGAGCAATAACGAAAAATGTTTGTCATAAACCGTTTTTCATTATTGCTCCTGACCTCCTCTCATTTG | 1005 | mir-240* (Kosik) | TCAAGAGCAATAACGAAAAATGT | 1229 |
| mir-232* (Kosik) | CAGAGCCTGGAGTGGGGGGGCAGGAGGGGCTCAGGGAGAAAGTGCATACAGCCCCTGGCCCTCTCTGCCCTTCCGTCCCCTGCTCTT | 1006 | mir-232* (Kosik) | CTGGCCCTCTCTGCCCTTCCGT | 1230 |
| mir-227* (Kosik)/mir-226* (Kosik) | TGACTATGCCTCCCCGCATCCCCTAGGGCATTGGTGTAAAGCTCGAGACCCACTGCCCCAGGTGCTGCTGGGGGTTGTAGTCT | 1007 | mir-226* (Kosik) | ACTGCCCCAGGTGCTGCTGG | 1231 |
| mir-227* (Kosik)/mir-226* (Kosik) | TGACTATGCCTCCCCGCATCCCCTAGGGCATTGGTGTAAAGCTGGAGACCCACTGCCCCAGGTGCTGCTGGGGGTTGTAGTCT | 1007 | mir-324-3p_Ruvkun | CCACTGCCCCAGGTGCTGCTGG | 1232 |
| mir-227* (Kosik)/mir-226* (Kosik) | TGACTATGCCTCCCCGCATCCCCTAGGGCATTGGTGTAAAGCTGGAGACCCACTGCCCCAGGTGCTGCTGGGGGTTGTAGTCT | 1007 | mir-227* (Kosik) | CGCATCCCCTAGGGCATTGGTGT | 1233 |
| mir-244* (Kosik) | ACGGCTGTCCTCTCCAACAATATCCTGGTGCTGAGTGATGACTCAGGCGACTCCAGCATCAGTGATTTTGTTGAAGAGGGCAGCTGCCA | 1008 | mir-244* (Kosik) | TCCAGCATCAGTGATTTGTTGA | 1234 |
| mir-224* (Kosik) | TGGTACTTGGAGAGAGGTGGTCCGTGGCGCGTTCGCTTTATTTATGGCGCACATTACACGGTCGACCTCTTTGCAGTATCTA | 1009 | mir-224* (Kosik) | GCACATTACACGGTCGACCTCT | 1235 |
| mir-248* (Kosik) | GAAACTGGGCTCAAGGTGAGGGTGCTATCTGTGATTGAGGGACATGGTTAATGGAATTGTCTCACACAGAAATCGCACCCGTCACCTTGGCCTACTTATCA | 1010 | mir-248* (Kosik) | TCTCACACAGAAATCGCACCCGTC | 1236 |
| ribosomal protein L5/ hypothetical miRNA 168_2 | ATCTATGAAGGCCAAGTGGAGGTGACTGGTGATGAATACAATGTGGAAAGCATTGATGGTCAGCCAGGTGCCTTCACCTGCTATTTGGATG | 1011 | hypothetical miRNA-168 | AGCCAGGTGCCTTCACCTGCT | 1155 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| hypothetical miRNA-177_3 | CAGTGCTTTCAGCAAG AGGGTGGTACCACATG TCTTCAAAATGAAACG TCTCTTGGAGACAAAC ATGCTACTCTCACTGC AGTTGAAAAAAGTCAG A | 1012 | hypothetical miRNA-177 | AGACAAACATGCTACTCTCAC | 1164 |
| mir-138_3 | ATGGTGTGGTGGGGCA GCTGGTGTTGTGAATC AGGCCGTTGCCAATCA GAGAACGGCTACTTCA CAACACCAGGGCCACA CCACACTACA | 1013 | mir-138 | AGCTGGTGTTGTGAATC | 256 |
| mir-138_3 | ATGGTGTGGTGGGGCA GCTGGTGTTGTGAATC AGGCCGTTGCCAATCA GAGAACGGCTACTTCA CAACACCAGGGCCACA CCACACTACA | 1013 | mir-138_Ruvkun | AGCTGGTGTTGTGAATCAGGCCG | 1127 |
| mir-138_4 | GGAATCAGATTAGCTG GTGTTGTGAATCTCCA TCTGAACTAAGATGGA CAGTAAGAGAATCCCA ATATCTTAGTAAATCT GTTACT | 1014 | mir-138 | AGCTGGTGTTGTGAATC | 256 |
| mir-181b_2 | ATGGCTGCACTCAACA TTCATTGCTGTCGGTG GGTTTGAGTCTGAATC AACTCACTGATCAATG AATGCAAACTGCGGAC CAAA | 1015 | mir-181b | AACATTCATTGCTGTCGGTGGGTT | 260 |
| mir-219_1 | GGGCCGCGGCTCCTGA TTGTCCAAACGCAATT CTCGAGTCTATGGCTC CGGCCGAGAGTTGAGT CTGGACGTCCCGAGCG GCCGCCCCC | 1016 | mir-219 | TGATTGTCCAAACGCAATTCT | 271 |
| mir-105_2 | TGTGTGTGCATCGTGG TCAAATGCTCAGACTC CTGTGGTGGCTGCTTA TGCACCACGGATGTTT GAGCATGTGCTATGGT GTCTACTT | 1017 | miR-105 (Mourelatos) | TCAAATGCTCAGACTCCTGT | 1185 |
| hypothetical miRNA 120_2 | TCTTCCAGTCATCCTG AGGTAGATATCATACA GGAATGCTGGGGCCTT ATGGCTTACAGCAATC CAGTAATGATATAAAA GATGATTGGAGGTTA | 1018 | hypothetical miRNA-120 | TTACAGCAATCCAGTAATGAT | 1138 |
| cezanne 2/ hypothetical miRNA-180 | ACGCAGTCCTGTCAGA CTTTGTTCGGTCCACG GGGGCAGAACCTGGTC TGGCCAGAGACCTGCT GG | 1019 | hypothetical miRNA-180 | TCCTGTCAGACTTTGTTCGGT | 1237 |
| mir-103_2 | TTGTGCTTTCAGCTTC TTTACAGTGCTGCCTT GTAGCATTCAGGTCAA GCAGCATTGTACAGGG CTATGAAAGAACCA | 1020 | mir-103 | AGCAGCATTGTACAGGGCTATGA | 225 |
| mir-147 (Sanger) | AATCTAAAGACAACAT TTCTGCACACACACCA GACTATGGAAGCCAGT | 1021 | miR-147 (RFAM-Human) | GTGTGTGGAAATGCTTCTGC | 1238 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTGTGGAAATGCTTCT GCTAGATT | | | | |
| mir-224 (Sanger) | GGGCTTTCAAGTCACT AGTGGTTCCGTTTAGT AGATGATTGTGCATTG TTTCAAAATGGTGCCC TAGTGACTACAAAGCC C | 1022 | miR-224 (RFAM-Human) | CAAGTCACTAGTGGTTCCGTTTA | 1239 |
| mir-134 (Sanger) | CAGGGTGTGTGACTGG TTGACCAGAGGGGCAT GCACTGTGTTCACCCT GTGGGCCACCTAGTCA CCAACCCTC | 1023 | miR-134 (RFAM-Human) | TGTGACTGGTTGACCAGAGGG | 1240 |
| mir-146 (Sanger) | CCGATGTGTATCCTCA GCTTTGAGAACTGAAT TCCATGGGTTGTGTCA GTGTCAGACCTCTGAA ATTCAGTTCTTCAGCT GGGATATCTCTGTCAT CGT | 1024 | miR-146 (RFAM-Human) | TGAGAACTGAATTCCATGGGTT | 1241 |
| mir-150 (Sanger) | CTCCCCATGGCCCTGT CTCCCAACCCTTGTAC CAGTGCTGGGCTCAGA CCCTGGTACAGGCCTG GGGGACAGGGACCTGG GGAC | 1025 | miR-150 (RFAM-Human) | TCTCCCAACCCTTGTACCAGTG | 1242 |
| mir-30e (RFAM/mmu) | TGGGCAGTCTTTGCTA CTGTAAACATCCTTGA CTGGAAGCTGTAAGGT GTTCAGAGGAGCTTTC AGTCGGATGTTTACAG CGGCAGGCTGCCACGG | 1026 | miR-30e (RFAM-M.mu.) | TGTAAACATCCTTGACTGGA | 1243 |
| mir-30e (RFAM/mmu) | TGGGCAGTCTTTGCTA CTGTAAACATCCTTGA CTGGAAGCTGTAAGGT GTTCAGAGGAGCTTTC AGTCGGATGTTTACAG CGGCAGGCTGCCACGG | 1026 | miR-97 (Michael et al) | TGTAAACATCCTTGACTGGAAG | 1244 |
| mir-296 (RFAM/mmu) | GACCCTTCCAGAGGGC CCCCCCTCAATCCTGT TGTGCCTAATTCAGAG GGTTGGGTGGAGGCTC TCCTGAAGGGC | 1027 | miR-296 (RFAM-M. M.mu.) | AGGGCCCCCCCTCAATCCTGT | 1245 |
| mir-299 (RFAM/mmu) | CGGTACTTGAAGAAAT GGTTTACCGTCCCACA TACATTTTGAATATGT ATGTGGGATGGTAAAC CGCTTCTTGGTATCC | 1028 | miR-299 (RFAM-M.mu.) | TGGTTTACCGTCCCACATACAT | 1246 |
| mir-301 (REAM/mmu) | TTACTGCTAACGAATG CTCTGACTTTATTGCA CTACTGTACTTTACAG CTAGCAGTGCAATAGT ATTGTCAAAGCATCTG AAAGCAGGA | 1029 | miR-301 (RFAM-M.mu.) | CAGTGCAATAGTATTGTCAAAGC | 1247 |
| mir-301 (RFAM/mmu) | TTACTGCTAACGAATG CTCTGACTTTATTGCA CTACTGTACTTTACAG CTAGCAGTGCAATAGT ATTGTCAAAGCATCTG AAAGCAGGA | 1029 | mir-301_Ruvkun | CAGTGCAATAGTATTGTCAAAGCAT | 1248 |
| mir-302 (RFAM/mmu) | CAAGACTGGGCTCCCC ACCACTTAAACGTGGA | 1030 | miR-302 (RFAM- | TAAGTGCTTCCATGTTTTGGTGA | 1249 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TGTACTTGCTTTGAAA CTAAAGAAGTAAGTGC TTCCATGTTTTGGTGA TGGTAAGTCTTCCTTT | | M.mu.) | | |
| mir-34a (RFAM/mmu) | TGAGTCTAGTTACTAG GCAGTGTAGTTAGCTG ATTGCTAATAGTACCA ATCACTAACCACACGG CCAGGTAAAAAGATTT G | 1031 | mir-34c (RFAM) | AGGCAGTGTAGTTAGCTGATTG | 1250 |
| mir-34a (RFAM/mmu) | TGAGTCTAGTTACTAG GCAGTGTAGTTAGCTG ATTGCTAATAGTACCA ATCACTAACCACACGG CCAGGTAAAAAGATTT G | 1031 | miR-34a (RFAM-M.mu.) | AGGCAGTGTAGTTAGCTGATTGC | 1251 |
| mir_320 | CGGCGGTTGGCTCCCC TCCGCCTTCTCTTCCC GGTTCTTCCCGGAGTC GGGAAAAGCTGGGTTG AGAGGGCGAAAAGGA TGAGGTGACTG | 1032 | miR-320 | AAAAGCTGGGTTGAGAGGGCGAA | 1252 |
| mir-321_1 | ATGGATAAGGCATTGG CCTCCTAAGCCAGGGA TTGTGGGTTCGAGTCC CATCTGGGGTGGCCTG TGACTTTTGTCCTTTT T | 1033 | miR-321-1 | TAAGCCAGGGATTGTGGGTTC | 1253 |
| mir-135b (Ruvkun) | TGCTGTGGCCTATGGC TTTTCATTCCTATGTG ATTGCTGTCCCAAACT CATGTAGGGCTAAAAG CCATGGGCTACAGTG | 1034 | mir-135b (Ruvkun) | TATGGCTTTTCATTCCTATGTG | 1254 |
| mir-151* (Ruvkun) | TTTCCTGCCCTCGAGG AGCTCACAGTCTAGTA TGTCTCATCCCCTACT AGACTGAAGCTCCTTG AGGACAGGGAT | 1035 | mir-151 (human) | ACTAGACTGAAGCTCCTTGAGG | 1255 |
| mir-151* (Ruvkun) | TTTCCTGCCCTCGAGG AGCTCACAGTCTAGTA TGTCTCATGCCCTACT AGACTGAAGCTCCTTG AGGACAGGGAT | 1035 | mir-151* (Ruvkun) | TCGAGGAGCTCACAGTCTAGTA | 1256 |
| mir-340 (Ruvkun) | TGTACCTGGTGTGATT ATAAAGCAATGAGACT GATTGTCATATGTCGT TTGTGGGATCCGTCTC AGTTACTTTATAGCCA TACCTGGTATG | 1036 | mir-340 (Ruvkun) | TCCGTCTCAGTTACTTTATAGCC | 1257 |
| mir-331 (Ruvkun) | TGTTTGGGTTTGTTCT AGGTATGGTCCCAGGG ATCCCAGATCAAACCA GGCCCCTGGGCCTATC CTAGAACCAACCTAAG CT | 1037 | mir-331 (Ruvkun) | GCCCCTGGGCCTATCCTAGAA | 1258 |
| mir_200c (RFAM) | GCGGGGGCCCTCGTCT TACCCAGCAGTGTTTG GGTGCGGTTGGGAGTC TCTAATACTGCCGGGT AATGATGGAGGCCCCT CT | 1038 | mir-200c (RFAM) | AATACTGCCGGGTAATGATGGA | 1259 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir_34b (RFAM) | TGCTCGGTTTGTAGGC AGTGTCATTAGCTGAT TGTACTGTCGTGGTTA CAATCACTAACTCCAC TGCCATCAAAACAAGG CACAGCATCAC | 1039 | mir-34b (RFAM) | AGGCAGTGTCATTAGCTGATTG | 1260 |
| mir_339_1 (RFAM) | AGGGGCGGGCGGCCGC TCTCCCTGTCCTCCAG GAGCTCACGTGTGCCT GCCTGTGAGCGCCTCG ACGACAGAGCCGCGCC TGCCCCA | 1040 | mir-339 (RFAM) | TCCCTGTCCTCCAGGAGCTCA | 1261 |
| mir_339_2 (RFAM) | AGGGGCGGGGCGGCCG CTCTCCCTGTCCTCCA GGAGCTCACGTGTGCC TGCCTCTCAGCGCCTC GACGACAGAGCCGGCG CCTGCCCCA | 1041 | mir-339 (RFAM) | TCCCTGTCCTGCAGGAGCTCA | 1261 |
| mir-325 (Ruvkun) | AGTGCTTGGTTCCTAG TAGGTGTCCAGTAAGT GTTTGTGACATAATTT GTTTATTGAGCACCTC CTATCAATCAAGCACT GTGCTAGGCTCTGG | 1042 | mir-325 (human) | CCTAGTAGGTGTCCAGTAAGTGT | 1262 |
| mir-326 (Ruvkun) | CTCATCTGTCTGTTGG GCTGCAGGCAGGGCCT TTGTGAAGGCGGGTGG TGCTCAGATCGCCTCT GGGCCCTTCCTCCAGC CCCGAGGCGGATT | 1043 | miR-326 (Ruvkun) | CCTCTGGGCCCTTCCTCCAG | 1263 |
| mir-326 (Ruvkun) | CTCATCTGTCTGTTGG GCTGGAGGCAGGGCCT TTGTGAAGGCGGGTGG TGCTCAGATCGCCTCT GGGCCCTTCCTCCAGC CCCGAGGCGGATT | 1044 | mir-326 (human) | CCTCTGGGCCCTTCCTCCAGC | 1264 |
| mir-329-1 (Ruvkun) | TGGTACCTGAAGAGAG GTTTTCTGGGTTTCTG TTTCTTTAATGAGGAC GAAACACACCTGGTTA ACCTCTTTTCCAGTAT CAAATCC | 1045 | mir-329 (human) | AACACACCTGGTTAACCTCTTT | 1265 |
| mir-329-2 (Ruvkun) | TGGTACCTGAAGAGAG GTTTTCTGGGTTTCTG TTTCTTTATTGAGGAC GAAACACACCTGGTTA ACCTCTTTTCCAGTAT CAAATCC | 1046 | mir-329 (human) | AACACACCTGGTTAACCTCTTT | 1265 |
| mir-330 (Ruvkun) | CTTTGGCGATCACTGC CTCTCTGGGCCTGTGT CTTAGGCTCTGCAAGA TCAACCGAGCAAAGCA CACGGCCTGCAGAGAG GCAGCGCTCTGC | 1047 | mir-330 (human) | GCAAAGCACACGGCCTGCAGAGA | 1266 |
| mir-337 (Ruvkun) | GTAGTCAGTAGTTGGG GGGTGGGAACGGCTTC ATACAGGAGTTGATGC ACAGTTATCCAGCTCC TATATGATGCCTTTCT TCATCCCCTTCAA | 1048 | mir-337 (human) | TCCAGCTCCTATATGATGCCTTT | 1267 |
| mir-345 (Ruvkun) | CTGCTGACTCCTAGTC CAGGGCTCGTGATGGC | 1049 | mir-345 (human) | TGCTGACTCCTAGTCCAGGGC | 1268 |

TABLE 60-continued

Human pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TGGTGGGCCCTGAACG AGGGGTCTGGAGGCCT GGGTTTGA | | | | |
| mir-346 (Ruvkun) | TCTGTGTTGGGCGTCT GTCTGCCCGCATGCCT GCCTCTCTGTTGCTCT GAAGGAGGCAGGGGCT GGGCCTGCAGCTGCCT GGGCAGAGCGGCTCCT | 1050 | mir-346 (human) | TGTCTGCCCGCATGCGTGCCTCT | 1269 |
| mir-187 | GGTCGGGCTCACCATG ACACAGTGTGAGACCT CGGGCTACAACACAGG ACCCGGGCGCTGCTCT GACCCCTCGTGTCTTG TGTTGCAGCCGGAGGG ACGCAGGTCCGCA | 1051 | miR-187 (RFAM-Human) | TCGTGTCTTGTGTTGCAGCCG | 1270 |
| mir-187 | GGTCGGGCTCACCATG ACACAGTGTGAGACCT CGGGCTACAACACAGG ACCCGGGCGCTGCTCT GACCCCTCGTGTCTTG TGTTGCAGCCGGAGGG ACGCAGGTCCGCA | 1051 | mir-187 | TCGTGTCTTGTGTTGCAGCCGG | 276 |
| miR-24-1 | CCCTCCGGTGCCTACT GAGCTGATATCAGTTC TCATTTTACACACTGG CTCAGTTCAGCAGGAA CAG | 1052 | miR-189 (RFAM-Human) | GTGCCTACTGAGCTGATATCAGT | 1271 |
| miR-24-1 | CCCTCCGGTGCCTACT GAGCTGATATCAGTTC TCATTTTACACACTGG CTCAGTTCAGCAGGAA CAG | 1052 | mir-24 | TGGCTCAGTTCAGCAGGAACAG | 264 |
| mir-215 | TGGTATACAGGAAAAT GACCTATGAATTGACA GACAATATAGCTGAGT TTGTCTGTCATTTCTT TAGGCCAATATTCTGT ATGACTGTGCTACTT | 1053 | mir-215 | ATGACCTATGAATTGACAGAC | 278 |

A list of mouse pri-miRNAs and the mature miRNAs predicted to derive from them is shown in Table 61. "Pri-miRNA name" indicates the gene name for each of the pri-miRNAs, and "pri-miRNA sequence" indicates the sequence of the predicted primary miRNA transcript. Also given in table 61 are the name and sequence of the mature miRNA derived from the pri-miRNA. Mature miRNA sequences from pri-miRNA precursors have been proposed by several groups; consequently, for a given pri-miRNA sequence, several miRNAs may be disclosed and given unique names, and thus a given pri-miRNA sequence may occur repeatedly in the table. The sequences are written in the 5' to 3' direction and are represented in the DNA form. It is understood that a person having ordinary skill in the art would be able to convert the sequence of the targets to their RNA form by simply replacing the thymidine (T) with uracil (U) in the sequence.

TABLE 61

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-26b | GCCCGGGACCCAGTT CAAGTAATTCAGGAT AGGTTGTGGTGCTGA CCAGCCTGTTCTCCA | 1273 | miR-99 (Mourelatos) | TTCAAGTAATTCAGGATAGGT | 1147 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TTACTTGGCTCGGGG GCCGGTGC | | | | |
| mir-26b | GCCCGGGACCCAGTT CAAGTAATTCAGGAT AGGTTGTGGTGCTGA CCAGCCTGTTCTCCA TTACTTGGCTCGGGG GCCGGTGC | 1273 | miR-199-as | TTCAAGTAATTCAGGATAGGTT | 281 |
| mir-30a | GACAGTGAGCGACTG TAAACATCCTCGACT GGAAGCTGTGAAGCC ACAAATGGGCTTTCA GTCGGATGTTTGCAG CTGCCTACTGC | 1274 | miR-199-as | CTTTCAGTCGGATGTTTGCAGC | 193 |
| mir-30a | GACAGTGAGCGACTG TAAACATCCTCGACT GGAAGCTGTGAAGCC ACAAATGGGCTTTCA GTCGGATGTTTGCAG CTGCCTACTGC | 1274 | mir-26b (RFAM-Human) | TGTAAACATCCTCGACTGGAAGC | 1184 |
| mir-30c_1 | GAGTGACAGATATTG TAAACATCCTACACT CTCAGCTGTGAAAAG TAAGAAAGCTGGGAG AAGGCTGTTTACTCT CTCTGCCTTG | 1275 | miR-32 (Tuschl) | TGTAAACATCCTACACTCTCAGC | 280 |
| mir-30c_1 | GAGTGACAGATATTG TAAACATCCTACACT CTCAGCTGTGAAAAG TAAGAAAGCTGGGAG AAGGCTGTTTACTCT CTCTGCCTTG | 1275 | let-7c_Ruvkun | TGTAAACATCCTACACTCTCAGCT | 1129 |
| mir-128a | CCTGAGCTGTTGGAT TCGGGGCCGTAGCAC TGTCTGAGAGGTTTA CATTTCTCACAGTGA ACCGGTCTCTTTTTC AGCTGCTTC | 1276 | mir-214 | TCACAGTGAACCGGTCTCTTT | 1073 |
| mir-128a | CCTGAGCTGTTGGAT TCGGGGCCGTAGCAC TGTCTGAGAGGTTTA CATTTCTCACAGTGA ACCGCTCTCTTTTTC AGCTGCTTC | 1276 | miR-29b (RFAM-Human) | TCACAGTGAACCGGTCTCTTTT | 200 |
| mir-29b_1 | CTCTTCTTCTGGAAG CTGGTTTCACATGGT CGCTTAGATTTTTCC ATCTTTGTATCTAGC ACCATTTGAAATCAG TGTTTTAGGAGTAAG AA | 1277 | mir-196 | TAGCACCATTTGAAATCAGT | 1172 |
| mir-29b_1 | CTCTTCTTCTGGAAG CTGGTTTCACATGGT GGCTTAGATTTTTCC ATCTTTGTATCTAGC ACCATTTGAAATCAG TGTTTTAGGAGTAAG AA | 1277 | hypothetical miRNA-079 | TAGCACCATTTGAAATCAGTGT | 1173 |
| mir-29b_1 | CTCTTCTTCTGGAAG CTGGTTTCACATGGT GGCTTAGATTTTTCC ATCTTTGTATCTAGC | 1277 | mir-30c | TAGCACCATTTGAAATCAGTGTT | 195 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ACCATTTGAAATCAG TGTTTTAGGAGTAAG AA | | | | |
| mir-29c | GCCTGACCGATTTCT CCTGGTGTTCAGAGT CTGTTTTTGTCTAGC ACCATTTGAAATCGG TTA | 1278 | mir-131_Ruvkun | CTAGCACCATTTGAAATCGGTT | 232 |
| mir-29c | GGCTGACCGATTTCT CCTGGTGTTCAGAGT CTGTTTTTGTCTAGC ACCATTTGAAATCGG TTA | 1278 | hypothetical miRNA-033 | TAGCACCATTTGAAATCGGTTA | 1100 |
| mir-123/mir-126 | CGGTGACAGCACATT ATTACTTTTGGTACG CGCTGTGACACTTCA AACTCGTACCGTGAG TAATAATGCGCGGTC AGCAGC | 1279 | mir-326 (rodent) | CATTATTACTTTTGGTACGCG | 205 |
| mir-123/mir-126 | CGGTGACAGCACATT ATTACTTTTGGTACG CGCTGTGACACTTCA AACTCGTACCGTGAG TAATAATGCGCGGTG AGCAGC | 1279 | mir-126 | TCGTACCGTGAGTAATAATGC | 1076 |
| mir-130a | GGGTGAGGAGGCGGG CCGGCATGCCTTTGC TGCTGGCCGGAGCTC TTTTCACATTGTGCT ACTGTCTAACGTGTA CCGAGCAGTGCAATG TTAAAAGGGCATCGG CCTTGTAGTACTACC CAGTGCCGGCAGCCT CCTCAG | 1280 | mir-23a | CAGTGCAATGTTAAAAGGGC | 233 |
| mir-130a | GGGTGAGGAGGCGGG CCGGCATGCCTTTGC TGCTGGCCGGAGCTC TTTTCACATTGTGCT ACTGTCTAACGTGTA CCGAGCAGTGCAATG TTAAAAGGGCATCGG CCTTGTAGTACTACC CAGTGCCGGCAGCCT CCTCAG | 1280 | hypothetical miRNA-040 | CAGTGCAATGTTAAAAGGGCAT | 1101 |
| mir-1d_1 | TACCTGCTTGGGACA CATACTTCTTTATAT GCCCATATGAACCTG CTAAGCTATGGAATG TAAAGAAGTATGTAT TTCAGGCTAGGA | 1281 | mir-132 | TGGAATGTAAAGAAGTATGTA | 1083 |
| mir-1d_1 | TACCTGCTTGGGACA CATACTTCTTTATAT GCCCATATGAACCTG CTAAGCTATGGAATG TAAAGAAGTATGTAT TTCAGGCTAGGA | 1281 | mir-124a (Kosik) | TGGAATGTAAAGAAGTATGTAT | 213 |
| mir-1d_1 | TACCTGCTTGGGACA CATACTTCTTTATAT GCCCATATGAACCTG CTAAGCTATGGAATG TAAAGAAGTATGTAT TTCAGGCTAGGA | 1281 | miR-200b | TGGAATGTAAAGAAGTATGTATT | 1134 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
| --- | --- | --- | --- | --- | --- |
| mir-124a_3 | TGAGGGCCCCTCTGC GTGTTCACAGCGGAC CTTGATTTAATGTCT ATACAATTAAGGCAC GCGGTGAATGCCAAG AGAGGCGCCTC | 1282 | mir-100 | TAAGGCACGCGGTGAATGCCA | 1104 |
| mir-124a_3 | TGAGGGCCCCTCTGC GTGTTCACAGCGGAC CTTGATTTAATGTCT ATACAATTAAGGCAC GCGGTGAATGCCAAG AGAGGCGCCTC | 1282 | mir-212 | TTAAGGCACGCGGTGAATGCCA | 235 |
| mir-124a_3 | TGAGGGCCCCTCTGC GTGTTCACAGCGGAC CTTGATTTAATGTCT ATACAATTAAGGCAC GCGGTGAATGCCAAG AGAGGCGCCTC | 1282 | let-7a | TTAAGGCACGCGGTGAATGCCAA | 1105 |
| mir-133a_2 | AATGCTTTGCTGAAG CTGGTAAAATGGAAC CAAATCAGCTGTTGG ATGGATTTGGTCCCC TTCAACCAGCTGTAG CTGCGCATTGA | 1283 | miR-189 (RFAM-Human) | TTGGTCCCCTTCAACCAGCTGT | 255 |
| mir-124a_2 | ACTCTGCTCTCCGTG TTCACAGCGGACCTT GATTTAATGTCATAC AATTAAGGCACGCGG TGAATGCCAAGAGCG GAGC | 1284 | mir-181c | TAAGGCACGCGGTGAATGCGA | 1104 |
| mir-124a_2 | ACTCTGCTCTCCGTG TTCACAGCGGACCTT GATTTAATGTCATAC AATTAAGGCACGCGG TGAATGCCAAGAGCG GAGC | 1284 | mir-108 | TTAAGGCACGCGGTGAATGCCA | 235 |
| mir-124a_2 | ACTCTGCTCTCCGTG TTCACAGCGGACCTT GATTTAATGTCATAC AATTAAGGCACGCGG TGAATGCCAAGAGCG GAGC | 1284 | mir-239* (Kosik) | TTAAGGCACGCGGTGAATGCCAA | 1105 |
| mir-131_1/mir-9 | GCGGGGTTGGTTGTT ATCTTTGGTTATCTA GCTGTATGAGTGGTG TGGAGTCTTCATAAA GCTAGATAACCGAAA GTAAAAATAACCCCA T | 1285 | mir-325 (rodent) | TAAAGCTAGATAACCGAAAGT | 211 |
| mir-131_1/mir-9 | GCGGGGTTGGTTGTT ATCTTTGGTTATCTA GCTGTATGAGTGGTG TGGAGTCTTCATAAA GCTAGATAACCGAAA GTAAAAATAACCCCA T | 1285 | mir-19b | TAAAGCTAGATAACCGAAAGTA | 1080 |
| mir-131_1/mir-9 | GCGGGGTTGGTTGTT ATCTTTGGTTATCTA GCTGTATGAGTGGTG TGGAGTCTTCATAAA GCTAGATAACCGAAA | 1285 | mir-124a_Ruvkun | TCTTTGGTTATCTAGCTGTATGA | 1081 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTAAAAATAACCCCAT | | | | |
| mir-15b | CCTTAAAGTACTGTAGCAGCACATCATGGTTTACATACTACAGTCAAGATGCGAATCATTATTTGCTGCTCTAGAAATTTAAGGA | 1286 | mir-152 | TAGCAGCACATCATGGTTTAC | 1115 |
| mir-15b | CCTTAAAGTACTGTAGCAGCACATCATGGTTTACATACTACAGTCAAGATGCGAATCATTATTTGCTGCTCTAGAAATTTAAGGA | 1286 | hypothetical miRNA-111 | TAGCAGCACATCATGGTTTACA | 246 |
| mir-16_3 | TTGTTCCACTCTAGCAGCACGTAAATATTGGCGTAGTGAAATAAATATTAAACACCAATATTATTGTGCTGCTTTAGTGTGAC | 1287 | miR-104 (Mourelatos) | TAGCAGCACGTAAATATTGGCG | 196 |
| mir-16_3 | TTGTTCCACTCTAGCAGCACGTAAATATTGGCGTAGTGAAATAAATATTAAACACCAATATTATTGTGCTGCTTTAGTGTGAC | 1287 | mir-128a | TAGCAGCACGTAAATATTGGCGT | 1176 |
| mir-137 | GACTCTCTTCGGTGACGGGTATTCTTGGGTGGATAATACGGATTACGTTGTTATTGCTTAAGAATACGCGTAGTCGAGGAGAGT | 1288 | mir-30b | TATTGCTTAAGAATACGCGTAG | 270 |
| mir-101_1 | CAGGCTGCCCTGGCTCAGTTATCACAGTGCTGATGCTGTCCATTCTAAAGGTACAGTACTGTGATAACTGAAGGATGGCAGCC | 1289 | mir-18 | TACAGTACTGTGATAACTGA | 265 |
| mir-101_1 | CAGGCTGCCCTGGCTCAGTTATCACAGTGCTGATGCTGTCCATTCTAAAGGTACAGTACTGTGATAACTGAAGGATGGCAGCC | 1289 | mir-128b | TACACTACTGTGATAACTGAAG | 1170 |
| mir-29a | AGGATGACTGATTTCTTTTGGTGTTCAGAGTCAATAGAATTTTCTAGCACCATCTGAAATCGGTTATAATG | 1291 | miR-27a (RFAM-M. mu.) | CTAGCACCATCTGAAATCGGTT | 247 |
| mir-29a | AGGATGACTGATTTCTTTTGGTGTTCAGAGTCAATAGAATTTTCTAGCACCATCTGAAATCGGTTATAATG | 1291 | mir-153 | TAGCACCATCTGAAATCGGTTA | 1116 |
| mir-29b_2 | AAGCTGGTTTCATATGGTGGTTTAGATTTAAATAGTGATTGTCTAGCACCATTTGAAATCAGTGTT | 1292 | mir-138_Ruvkun | TAGCACCATTTGAAATCAGT | 1172 |
| mir-29b_2 | AAGCTGGTTTCATATGGTGGTTTAGATTTA | 1292 | hypothetical miRNA-075 | TAGCACCATTTGAAATCAGTGT | 1173 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | AATAGTGATTGTCTA GCACCATTTGAAATC AGTGTT | | | | |
| mir-29b_2 | AAGCTGGTTTCATAT GGTGGTTTAGATTTA AATAGTGATTGTCTA GCACCATTTGAAATC AGTGTT | 1292 | miR-30a-s | TAGCACCATTTGAAATCAGTGTT | 195 |
| mir-148a | TGAGACAAAGTTCTG AGACACTCCGACTCT GAGTATGATAGAAGT CAGTGCACTACAGAA CTTTGTCTCTAG | 1293 | miR-1d (Tuschl) | TCAGTGCACTACAGAACTTTGT | 288 |
| mir-141 | TGGCTGGCTCTGGGT CCATCTTCCAGTGCA GTGTTGGATGGTTGA AGTATGAAGCTCCTA ACACTGTCTGGTAAA GATGGCCCCCGGGTC AGTT | 1294 | mir-16_Ruvkun | AACACTGTCTGGTAAAGATGG | 261 |
| mir-131_3/mir-9 | AATGGGAGGCCCGTT TCTCTCTTTGGTTAT CTACCTGTATGAGTG CCACAGAGCCGTCAT AAAGCTAGATAACCG AAAGTAGAAATGACT CTCAC | 1295 | mir-124a (Kosik) | TAAAGCTAGATAACCGAAAGT | 211 |
| mir-131_3/mir-9 | AATGGGAGGCCCGTT TCTCTCTTTGGTTAT CTAGCTGTATGAGTG CCACAGAGCCGTCAT AAAGCTAGATAACCG AAAGTAGAAATGACT CTCAC | 1295 | mir-7b (rodent) | TAAAGCTAGATAACCGAAAGTA | 1080 |
| mir-131_3/mir-9 | AATGGGAGGCCCGTT TCTCTCTTTGGTTAT CTAGCTGTATGAGTG CCACAGAGCCGTCAT AAAGCTAGATAACCG AAAGTAGAAATGACT CTCAC | 1295 | mir-19a | TCTTTGGTTATCTAGCTGTATGA | 1081 |
| mir-23a | TCGGACGGCTGGGGT TCCTGGGGATGGGAT TTGATGCCAGTCACA AATCACATTGCCAGG GATTTCCAACTGACC C | 1296 | miR-1 (RFAM) | ATCACATTGCCAGGGATTTCC | 289 |
| mir-24_2 | TCTGCCTCTCTCCGG GCTCCGCCTCCCGTG CCTACTGAGCTGAAA CAGTTGATTCCAGTG CACTGGCTCAGTTCA GCAGGAACAGGAGTC CAGCCCCCTAGGAGC TGGCAA | 1297 | mir-124a_Ruvkun | TGGCTCAGTTCAGCAGGAACAG | 264 |
| mir-140 | TCTGTGTCCTGCCAG TGGTTTTACCCTATG GTAGGTTACGTCATG CTGTTCTACCACAGG GTAGAACCACGGACA GGGTACTG | 1298 | miR-199b (mouse) | AGTGGTTTTACCCTATGGTAG | 192 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
| --- | --- | --- | --- | --- | --- |
| mir-140 | TCTGTGTCCTGCCAG TGGTTTTACCCTATG GTAGGTTACGTCATG CTGTTCTACCACAGG GTAGAACCACGGACA GGGTACTG | 1298 | mir-205 | TACCACAGGGTAGAACCACGGA | 1065 |
| mir-140 | TCTGTGTCCTGCCAG TGGTTTTAGCCTATG GTAGGTTAGGTCATG CTGTTCTAGGAGAGG GTAGAACCACGGACA GGGTAGTG | 1298 | mir-26b | TACCACAGGGTAGAACCACGGACA | 1066 |
| let-7a_4 | TTCCGAGGTTGAGGT AGTAGGTTGTATAGT TTAGAGTTACATCAA GGGAGATAACTGTAC AGCCTCCTAGCTTTC CTTGGG | 1299 | mir-16_Ruvkun | TGAGGTAGTAGGTTGTATAGTT | 222 |
| mir-125b_1 | GCTCCGCTCAGTCCC TGAGACGCTAAGTTG TGATGTTTAGCGTTT AAATCGAGGGGTTAG GGTGTTGGGAGGTGG GGGTCG | 1300 | mir-131_Ruvkun | TCCGTGAGACGGTAAGTTGTGA | 258 |
| mir-26a_1 | GAAGGGGGTGGCGTC GTTCAAGTAATGCAG GATAGGGTGTGGAGG TCCGAAGGGGCCTAT TGTTGGTTAGTTGGA GGGGGAGGGGGGGGT GGAG | 1301 | mir-29b | TTGAAGTAATCCAGGATAGGG | 1203 |
| mir-26a_1 | GAAGGGCGTGGGGTC GTTCAAGTAATCCAG GATAGGGTGTGGAGG TGCGAAGGGGCTAT TGTTGGTTACTTGGA GGGGACGGGGCGT GGAG | 1301 | hypothetical miRNA-154 | TTGAAGTAATGCAGGATAGGCT | 226 |
| let-7i | GAGAGGATGGGGGTG GGTGAGGTAGTAGTT TGTGGTGTTGGTGGG GTTGTGAGATTGGGG GCTGTGGAGATAAGT GGGGAAGGTAGTGCC TTGCTAGTGGTGGTG AT | 1302 | hypothetical miRNA-179 | TGAGGTAGTAGTTTGTGCT | 209 |
| let-7i | CAGACGATGGGCCTG GCTGAGGTAGTAGTT TGTGGTGTTGGTCGG GTTGTGAGATTGGCG GGTGTGGAGATAACT GGGCAAGCTACTGCC TTGGTAGTGCTGGTG AT | 1302 | miR-1d (Tuschl) | TGAGGTAGTAGTTTGTGGTGTT | 1078 |
| mir-21 | GGTGTAGCACGTTGT GGGATAGGTTATGAG AGTGATGTTGAGTGT TGAATGTGATGGGAA GAGGAGTGGATGGGG TGTGTGAGATTTTGG TATG | 1303 | mir-125b | TAGCTTATGAGAGTGATGTTGA | 236 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-22 | GGGTGAGGGGGAGTA GTTGTTGAGTGGGAA GGTTTATGTGGTGAG GGAGGTAAAGGTGGG AGTTGAAGAAGTGTT GCCCTCTGCCC | 1304 | mir-131 | AAGGTGGGAGTTGAAGAAGTGT | 215 |
| mir-142 | AGACAGTGCAGTCAC CCATAAAGTAGAAAG CACTACTAACAGCAC TGGAGGGTGTAGTGT TTCCTACTTTATGGA TGAGTGCACTGTG | 1305 | mir-131_Ruvkun | CATAAAGTAGAAAGCACTAC | 217 |
| mir-142 | AGACAGTGCAGTCAC CCATAAAGTAGAAAG CACTACTAACAGCAC TGGAGGGTGTAGTGT TTCCTACTTTATGGA TGAGTGCACTGTG | 1305 | hypothetical miRNA-105 | TGTAGTGTTTCCTACTTTATGG | 1086 |
| mir-142 | AGACAGTGCAGTCAC CCATAAAGTAGAAAG CACTACTAACAGCAC TGGAGGGTGTAGTGT TTCCTACTTTATGGA TGAGTGCACTGTG | 1305 | mir-218 | TGTAGTGTTTCCTACTTTATGGA | 1087 |
| mir-144 | GACCTTGGCTGGGAT ATCATCATATACTGT AAGTTTGTGATGAGA CACTACAGTATAGAT GATGTACTAGTCTGG GTA | 1306 | mir-26a | TACAGTATAGATGATGTACTAG | 237 |
| mir-152 | CCGGGCCTAGGTTCT GTGATACACTCCGAC TCGGGCTCTGGAGCA GTCAGTGCATGACAG AACTTGGGCCCGGT | 1307 | miR-99a (Tuschl) | TCAGTGCATGACAGAACTTGG | 282 |
| mir-153_2 | ACTTAGCGGTGGCCG GTGTCATTTTGTGA CGTTGCAGCTAGTAA TATGAGCCCAGTTGC ATAGTCACAAAAGTG ATCATTGGAAACTGT G | 1308 | mir-29c | TTGCATAGTCACAAAAGTGA | 201 |
| let-7a_1 | TCTCTTCACTGTGGG ATGAGGTAGTAGGTT GTATAGTTTTAGGGT CACACCCACCACTGG GAGATAACTATACAA TCTACTGTCTTTCCT AAGGTGATGGA | 1309 | mir-16 | TGAGGTAGTAGGTTGTATAGTT | 222 |
| let-7d | AAAATGGGTTCCTAG GAAGAGGTAGTAGGT TGCATAGTTTTAGGG CAGAGATTTTGCCCA CAAGGAGTTAACTAT ACGACCTGCTGCCTT TCTTAGGGCCTTATT AT | 1310 | mir-144 | AGAGGTAGTAGGTTGCATAGT | 245 |
| let-7d | AAAATGGGTTCCTAG GAAGAGGTAGTAGGT TGCATAGTTTTAGGG CAGAGATTTTGCCCA CAAGGAGTTAACTAT | 1310 | hypothetical miRNA-171 | AGAGGTAGTAGGTTGCATAGTT | 1113 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ACGACCTGCTGCCTT TCTTAGGGCCTTATT AT | | | | |
| let-7d | AAAATGGGTTCCTAG GAAGAGGTAGTAGGT TGCATAGTTTTAGGG CAGAGATTTTGCCCA CAAGGAGTTAACTAT ACGACCTGCTGCCTT TCTTAGGGCCTTATT AT | 1310 | miR-204 (Tuschl) | CTATACGACCTGCTGCCTTTCT | 1114 |
| let-7f_1 | ACTTGCTCTATCAGA GTGAGGTAGTAGATT GTATAGTTGTGGGGT AGTGATTTTACCCTG TTTAGGAGATAACTA TACAATCTATTGCCT TCCCTGAGGAGTAGA C | 1311 | miR-9 | TGAGGTAGTAGATTGTATAGT | 1098 |
| let-7f_1 | ACTTGCTCTATCAGA GTGAGGTAGTAGATT GTATAGTTGTGGGGT AGTGATTTTACCCTG TTTAGGAGATAACTA TACAATCTATTGCCT TCCCTGAGGAGTAGA C | 1311 | hypothetical miRNA-138 | TGAGGTAGTAGATTGTATAGTT | 231 |
| mir-23b | TCACCTGCTCTGGCT GCTTGGGTTCCTGGC ATGCTGATTTGTGAC TTGAGATTAAAATCA CATTGCCAGGGATTA CCACGCAACCATGAC CTTGGC | 1312 | mir-1d | ATCACATTGCCAGGGATTACCAC | 208 |
| miR-24-1 | GACCCGCCCTCCGGT GCCTACTGAGCTGAT ATCAGTTCTCATTTC ACACACTGGCTCAGT TCAGCAGGAACAGGA GTCGAG | 1313 | mir-124a (Kosik) | GTGCCTACTGAGCTGATATCAGT | 1271 |
| miR-24-1 | GACCCGCCCTCCGGT GCCTACTGAGCTGAT ATCAGTTCTCATTTC ACACACTGGCTCAGT TCAGCAGGAACAGGA GTCGAG | 1313 | hypothetical miRNA-070 | TGGCTCAGTTCAGCAGGAACAG | 264 |
| mir-27b | CCTCTCTAACAAGGT GCAGAGCTTAGCTGA TTGGTGAACAGTGAT TGGTTTCCGCTTTGT TCACAGTGGCTAAGT TCTGCACCTGAAGAG AAGGTG | 1314 | miR-29c (Tuschl) | TTCACAGTGGCTAAGTTCTG | 202 |
| mir-27b | CCTCTCTAACAAGGT GCAGAGCTTAGCTGA TTGGTGAACAGTGAT TGGTTTCCGCTTTGT TCACAGTGGCTAAGT TCTGCACCTGAAGAG AAGGTG | 1314 | mir-135 | TTCACAGTGGCTAAGTTCTGC | 1059 |
| mir-131_2/mir-9 | CCTTGTGAGGGAAGC GAGTTGTTATCTTTG GTTATCTAGCTGTAT | 1315 | mir-107 | TAAAGCTAGATAACCGAAAGT | 211 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GAGTGTATTGGTCTT CATAAAGCTAGATAA CCGAAAGTAAAAACT CCTTCAAGGTCACCG AGG | | | | |
| mir-131_2/mir-9 | CCTTGTGAGGGAAGC GAGTTGTTATCTTTG GTTATCTAGCTGTAT GAGTGTATTGGTCTT CATAAAGCTAGATAA CCGAAAGTAAAAACT CCTTCAAGGTCACCG AGG | 1315 | miR-224 (RFAM-mouse) | TAAAGCTAGATAACCGAAAGTA | 1080 |
| mir-131_2/mir-9 | CCTTGTGAGGGAAGC GAGTTGTTATCTTTG GTTATCTAGCTGTAT GAGTGTATTGGTCTT CATAAAGCTAGATAA CCGAAAGTAAAAACT CCTTCAAGGTCACCG AGG | 1315 | mir-124a | TCTTTGGTTATCTAGCTGTATGA | 1081 |
| mir-15a | AAGTAGCAGCACATA ATGGTTTGTGGATGT TGAAAAGGTGCAGGC CATACTGTGCTGCCT CAAAATACAA | 1316 | miR-20 (RFAM-Human) | TAGCAGCACATAATGGTTTGT | 1151 |
| mir-15a | AAGTAGCAGCACATA ATGGTTTGTGGATGT TGAAAAGGTGCAGGC CATACTGTGCTGCCT CAAAATACAA | 1316 | miR-92 (RFAM-M. mu.) | TAGCAGCACATAATGGTTTGTG | 269 |
| mir-16_1 | CCTTAGCAGCACGTA AATATTGGCGTTAAG ATTCTGAAATTACCT CCAGTATTGACTGTG CTGCTGAAGT | 1317 | mir-98 | TAGCAGCACGTAAATATTGGCG | 196 |
| mir-16_1 | CCTTAGCAGCACGTA AATATTGGCGTTAAG ATTCTGAAATTACCT CCAGTATTGACTGTG CTGCTGAAGT | 1317 | mir-30c_Ruvkun | TAGCAGCACGTAAATATTGGCGT | 1176 |
| mir-124a_1 | AGGCCTCTCTCTCCG TGTTCACAGCGGACC TTGATTTAAATGTCC ATACAATTAAGGCAC GCGGTGAATGCCAAG AATGGGGC | 1318 | miR-132 (RFAM-Human) | TAAGGCACGCGGTGAATGCCA | 1104 |
| mir-124a_1 | AGGCCTCTCTCTCCG TGTTCACAGCGGACC TTGATTTAAATGTCC ATACAATTAAGGCAC GCGGTGAATGCCAAG AATGGGGC | 1318 | miR-140-as | TTAAGGCACGCGGTGAATGCCA | 235 |
| mir-124a_1 | AGGCCTCTCTCTCCG TGTTCACAGCGGACC ATACAATTAAGGCAC GCGGTGAATGCCAAG AATGGGGC | 1318 | hypothetical miRNA-181 | TTAAGGCACGCGGTGAATGCCAA | 1105 |
| mir-18 | GCTTTTTGTTCTAAG GTGCATCTAGTGCAG ATAGTGAAGTAGACT AGCATCTACTGCCCT | 1319 | mir-124a | TAAGGTGCATCTAGTGCAGATA | 262 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | AAGTGCTCCTTCTGG CATAAG | | | | |
| mir-18 | GCTTTTTGTTCTAAG GTGCATCTAGTGCAG ATAGTGAAGTAGACT AGCATCTACTGCCCT AAGTGCTCCTTCTGG CATAAG | 1319 | miR-27 (Mourelatos) | TAAGGTGCATCTAGTGCAGATAG | 1177 |
| mir-20 | TGACAGCTTGTGTAG CACTAAAGTGCTTAT AGTGCAGGTAGTGTG TAGCCATCTACTGCA TTACGAGCACTTAAA GTACTGCCAGCTGTA | 1320 | mir-23b | TAAAGTGCTTATAGTGCAGGTA | 1126 |
| mir-20 | TGACAGCTTCTGTAG CACTAAAGTGCTTAT AGTGCAGGTAGTGTG TAGCCATCTACTGCA TTACGAGCACTTAAA GTACTGCCAGCTGTA | 1320 | mir-199a | TAAAGTGCTTATAGTGCAGGTAG | 254 |
| mir-30b | TCTAAGCCAAGTTTC AGTTCATGTAAACAT CCTACACTCAGCTGT CATACATGCGTTGGC TGGGATGTGGATGTT TACGTCAGCTGTCTT GGAGTATCCAC | 1321 | miR-31 (Tuschl) | TGTAAACATCCTACACTCAGC | 266 |
| mir-30b | TCTAAGCCAAGTTTC AGTTCATGTAAACAT CCTACACTCAGCTGT CATACATGCGTTGGC TGGGATGTGGATGTT TACGTCAGCTGTCTT GGAGTATCCAC | 1321 | mir-18_Ruvkun | TGTAAACATCCTACACTCAGCT | 1137 |
| mir-30d | TGCTGTCAGAAAGTC TGTGTCTGTAAACAT CCCCGACTGGAAGCT GTAAGCCACAGCCAA GCTTTCAGTCAGATG TTTGCTGCTACTGGC TCTTCGAATGCAT | 1322 | miR-186 | TGTAAACATCCCCGACTGGAAG | 240 |
| mir-30d | TGCTGTCAGAAAGTC TGTGTCTGTAAACAT CCCCGACTGGAAGCT GTAAGCCACAGCCAA GCTTTCAGTCAGATG TTTGCTGCTACTGGC TCTTCGAATGCAT | 1322 | let-7i_Ruvkun | TGTAAACATCCCCGACTGGAAGCT | 1108 |
| let-7b | GACACCGCAGGGTGA GGTAGTACGTTGTGT GGTTTCAGGGCAGTG ATGTTGCCCCTCCGA AGATAACTATACAAC CTACTGCCTTCCCTG AGGCGCCCAG | 1323 | mir-135 | TGAGGTAGTAGGTTGTGTGGTT | 212 |
| let-7b | GACACCGCAGGGTGA GGTAGTAGGTTGTGT GGTTTCAGGGCAGTG ATGTTGCCCCTCCGA AGATAACTATACAAC CTACTGCCTTCCCTG AGGCGCCCAG | 1323 | mir-133a | TGAGGTAGTAGGTTGTGTGGTTT | 1082 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| let7c_2 | GGCCTTTGGGGTGAGGTAGTAGGTTGTATGGTTTTGGGCTCTGCCCCGCTCTGCGGTAACTATACAATCTACTGTCTTTCCTGAAG | 1324 | let-7d* (RFAM-M. mu.) | TGAGGTAGTAGGTTGTATGGTT | 250 |
| let7c_2 | GGCCTTTGGGGTGAGGTAGTAGGTTGTATGGTTTTGGGCTCTGCCCCGCTCTGCGGTAACTATACAATCTACTGTCTTTCCTGAAG | 1324 | hypothetical miRNA-170 | TGAGGTAGTAGGTTGTATGGTTT | 1120 |
| let-7c_1 | AAGCTGTGTGCATCCGGGTTGAGGTAGTAGGTTGTATGGTTTAGAGTTACACCCTGGGAGTTAACTGTACAACCTTCTAGCTTTCCTTGGAGCACACTTGA | 1325 | let-7d | TGAGGTAGTAGGTTGTATGGTT | 250 |
| let-7c_1 | AAGCTGTGTGCATCCGGGTTGAGGTAGTAGGTTGTATGGTTTAGAGTTACACCCTGGGAGTTAACTGTACAACCTTCTAGCTTTCCTTGGAGCACACTTGA | 1325 | miR-135 (RFAM-Human) | TGAGGTAGTAGGTTGTATGGTTT | 1120 |
| mir-99 (Mourelatos) | ATGCCCATTGACATAAACCCGTAGATCCGATCTTGTGGTGAAGTGGACCGCGCAAGCTCGTTTCTATGGGTCTGTGGCAGTGTGGTGA | 1326 | miR-203 (Tuschl) | AACCCGTAGATCCGATCTTGTG | 1193 |
| mir-99 (Mourelatos) | ATGCCCATTGACATAAACCCGTAGATCCGATCTTGTGGTGAAGTGGACCGCGCAAGCTCGTTTCTATGGGTCTGTGGCAGTGTGGTGA | 1326 | mir-34 | ACCCGTAGATCCGATCTTGT | 1194 |
| LOC 114614 containing miR-155/ hypothetical miRNA-071 | TGAAGGCTGTATGCTGTTAATGCTAATTGTGATAGGGGTTTTGGCCTCTGACTGACTCCTACCTGTTAGCATTAACAGGACACAAGGCCTGTTA | 1327 | mir-187 | TTAATGCTAATTGTGATAGGGG | 1459 |
| let-7e | GCCGCGCCCCCCGGGCTGAGGTAGGAGGTTGTATAGTTGAGGAAGACACCCGAGGAGATCACTATACGGCCTCCTAGCTTTCCCGAGGCTGCGCCC | 1328 | let-7a | TGAGGTAGGAGGTTGTATAGT | 249 |
| mir-1d_2 | GTTTTCACAGCTATCGGCCGGCGCAGGAGTGCCTACTCAGAGCACATACTTCTTTATGTACCCATATGAACATTCAGTGCTATGGAATGTAAAGAAGTATGTATTTTGGGTAGGTAATGTCCGCCAAGAAGAAGCTAAAGGAAACT | 1329 | miR-10b (Michael et al) | TGGAATGTAAAGAAGTATGTA | 1083 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-1d_2 | GTTTTCACAGCTATCGGCCGGCGCAGGAGTGCCTACTCAGAGCACATACTTCTTTATGTACCCATATGAACATTCAGTGCTATGGAATGTAAAGAAGTATGTATTTTGGGTAGGTAATGTCCGCCAAGAAGAAGCTAAAGGAAACT | 1329 | miR-139 | TGGAATGTAAAGAAGTATGTAT | 213 |
| mir-1d_2 | GTTTTCACAGCTATCGGCCGGCGCAGGAGTGCCTACTCAGAGCACATACTTCTTTATGTACCCATATGAACATTCAGTGCTATGGAATGTAAAGAAGTATGTATTTTGGGTAGGTAATGTCCGCCAAGAAGAAGCTAAAGGAAACT | 1329 | mir-124a | TGGAATGTAAAGAAGTATGTATT | 1134 |
| mir-133a_1 | GCAATGCTTTGCTAAAGCTGGTAAAATGGAACCAAATCGCCTCTTCAATGGATTTGGTCCCCTTCAACCAGCTGTAGCTATGCATTGAT | 1330 | mir-24 | TTGGTCCCCTTCAACCAGCTGT | 255 |
| mir-143 | CCTGCGTGCGGAGCGCCTGTCTCCCAGCCTGAGGTGCAGTGCTGCATCTCTGGTCAGTTGGGAGTCTGAGATGAAGCACTGTAGCTCAGGAAGGGAGAAGATGTCCTGCAGCC | 1331 | miR-15b (Michael et al) | TGAGATGAAGCACTGTAGCTC | 1088 |
| mir-143 | CCTGCGTGCGGAGCGCCTGTCTCCCAGCCTGAGGTGCAGTGCTGCATCTCTGGTCAGTTGGGAGTCTGAGATGAAGCACTGTAGCTCAGGAAGGGAGAAGATGTCCTGCAGCC | 1331 | mir-253* (Kosik) | TGAGATGAAGCACTGTAGCTCA | 220 |
| mir-145 | TTGTCCTCACGGTCCAGTTTTCCCAGGAATCCCTTGGATGCTAAGATGGGGATTCCTGGAAATACTGTTCTTGAGGTCATG | 1332 | mir-148b | GTCCAGTTTTCCCAGGAATCC | 1122 |
| mir-145 | TTGTCCTCACGGTCCAGTTTTCCCAGGAATCCCTTGGATGCTAAGATGGGGATTCCTGGAAATACTGTTCTTGAGGTCATG | 1332 | let-7f | GTCCAGTTTTCCCAGGAATCCCTT | 252 |
| mir-122a | TTCCTTAGCAGAGCTGTGGAGTGTGACAATGGTGTTTGTGTCCAAACCATCAAACGCCATTATCACACTAAATAGCTACTG | 1333 | miR-172 (RFAM- M. mu.) | TGGAGTGTGACAATGGTGTTTG | 1084 |
| mir-122a | TTCCTTAGCAGAGCTGTGGAGTGTGACAATGGTGTTTGTGTCCAA | 1333 | mir-124a_Ruvkun | TGGAGTGTGACAATGGTGTTTGT | 214 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ACCATCAAACGCCAT TATCACACTAAATAG CTACTG | | | | |
| mir-19b_2 | CAGCGCAAGGACATT GCTACTTACGATTAG TTTTGCAGATTTGCA GTTCAGCGTATATGT GAATATATGGCTGTG CAAATCCATGCAAAA CTGATTGTGGGAATG TGTACCTTTCTGCA | 1334 | mir-22 | TGTGCAAATCCATGCAAAACTGA | 241 |
| let-7f_2 | CTGGTGCTCTGTGGG ATGAGGTAGTAGATT GTATAGTTTTAGGGT CATACCCCATCTTGG AGATAACTATACAGT CTACTGTCTTTCCCA CGGTGGTACAC | 1335 | hypothetical miRNA-137 | TGAGGTAGTAGATTGTATAGT | 1098 |
| let-7f_2 | CTGGTGCTCTGTGGG ATGAGGTAGTAGATT GTATAGTTTTAGGGT GATACCCCATCTTGG AGATAACTATACAGT CTACTGTCTTTCCCA CGGTGGTACAC | 1335 | mir-131 | TGAGGTAGTAGATTGTATAGTT | 231 |
| mir-26a_2 | CTACTGTGGAGGCTG CGGCTGGATTCAAGT AATCCAGGATAGGCT GTGTCCGTCCATGAG GCCTGTTCTTGATTA CTTGTTTCTGGAGGC AGCGCATGGTCTG | 1336 | mir-29a_Ruvkun | TTCAAGTAATCCAGGATAGGC | 1203 |
| mir-26a_2 | CTACTGTGGAGGCTG CGGCTGGATTCAAGT AATCCAGGATAGGCT GTGTCCGTCCATGAG GCCTGTTCTTGATTA CTTGTTTCTGGAGGC AGCGCATGGTCTG | 1336 | hypothetical miRNA-153 | TTCAAGTAATCCAGGATAGGCT | 226 |
| mir-127 | TTTGATCACTGTCTC CAGCCTGCTGAAGCT CAGAGGGCTCTGATT CAGAAAGATCATCGG ATCCGTCTGAGCTTG GCTGGTCGGAAGTCT CATCATCT | 1337 | mir-103 | TCGGATCCGTCTGAGCTTGG | 1204 |
| mir-127 | TTTGATCACTGTCTC CAGCCTGCTGAAGCT CAGAGGGCTCTGATT CAGAAAGATCATCGG ATCCGTCTGAGCTTG GCTGGTCGGAAGTCT CATCATCT | 1337 | mir-17as/mir-91 | TCGGATCCGTCTGAGCTTGGCT | 1205 |
| mir-136 | GAGCCCTCGGAGGAC TCCATTTGTTTTGAT GATGGATTCTTAAGC TCCATCATCGTCTCA AATGAGTCTTCAGAG GGTTC | 1338 | mir-91_Ruvkun | ACTCCATTTGTTTTGATGATGGA | 1206 |
| mir-154 | CGGTGCTTGAAGATA GGTTATCCGTGTTGC CTTCGCTTTATTCGT GACGAATCATACACG | 1339 | mir-17-3p (mouse) | TAGGTTATCCGTGTTGCCTTCC | 1207 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTTGACCTATTTTTCAGTACCAA | | | | |
| mir-149 | CCAGTGCCCAGGCTCTGGCTCCGTGTCTTCACTCCCGTGTTTGTCCGAGGAGGGAGGGAGGGACGGGGCGGTGCTGGGGCAACT | 1340 | let-7gL_Ruvkun | TCTGGCTCCGTGTCTTCACTCC | 1200 |
| mir-30c_2 | ACCATGTTGTAGTGTGTGTAAACATCCTACACTCTCAGCTGTGAGCTCAAGGTGGCTGGGAGAGGGTTGTTTACTCCTTCTGCCATGGAAA | 1341 | miR-31 (RFAM-M. mu.) | TGTAAACATCCTACACTCTCAGC | 280 |
| mir-30c_2 | ACCATGTTGTAGTGTGTGTAAACATCCTACACTCTCAGCTGTGAGCTCAAGGTGGCTGGGAGAGGGTTGTTTACTCCTTCTGCCATGGAAA | 1341 | let-7c | TGTAAACATCCTACACTCTCAGCT | 1129 |
| mir-99b | GTCCTGGCACCCACCCGTAGAACCGACCTTGCGGGGCCTTCGCCGCACACAAGCTCGTGTCTCTGGGTCCGTGTCGGGGGC | 1342 | mir-101b (rodent) | CACCCGTAGAACCGACCTTGCG | 1201 |
| MiR-125a | CCGGCCTCTGGGTCCCTGAGACCCTTTAACCTGTGAGGACGTCCAGGGTCACAGGTGAGGTTCTTGGGAGCCTGGCGCCTGGCCCAGCCACAAATTTAGGGATTTCAGGTGACCCCTGGCAA | 1343 | mir-106 (mouse) | TCCCTGAGACCCTTTAACCTGTG | 1202 |
| MiR-125b_2 | TGAGACCCTAACTTGTGAGACCCTAACTTGTGAGGTATTTTAGTAACATCACAAGTCAGGTTGTTGGGACCTAGGCGGAGG | 1344 | miR-9 | TCCCTGAGACCCTAACTTGTGA | 258 |
| mir-221 | TGAACATCCAGGTCTGGGGCATGAACCTGGCATAGAATGTAGATTTCTGTGTTTGTTAGGCAACAGCTACATTGTCTGCTGGGTTTCAGGCTACCTGGAA | 1345 | miR-200a (RFAM-Human) | AGCTACATTGTCTGCTGGGTTT | 1106 |
| mir-221 | TGAACATCCAGGTCTGGGGCATGAACCTGGCATACAATGTAGATTTCTGTGTTTGTTAGGCAACAGCTACATTGTCTGCTGGGTTTCAGGCTACCTGGAA | 1345 | miR-26a (Michael et al) | AGCTACATTGTCTGCTGGGTTTC | 238 |
| mir-203 | GGTCCAGTGGTTCTTGACAGTTCAACAGTTCTGTAGCACAATTGTGAAATGTTTAGGACCACTAGACCCGGCGCGCACGGCG | 1346 | mir-10b | GTGAAATGTTTAGGACCACTAG | 197 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-203 | GGTCCAGTGGTTCTT GACAGTTCAACAGTT CTGTAGCACAATTGT GAAATGTTTAGGACC ACTAGACCCGGCGCG CACGGCG | 1346 | mir-128 (Kosik) | TGAAATGTTTAGGACCACTAG | 1068 |
| mir-203 | GGTCCAGTGGTTCTT GACAGTTCAACAGTT CTGTAGCACAATTGT GAAATGTTTAGGACC ACTAGACCCGGCGCG CACGGCG | 1346 | mir-204 | TGAAATGTTTAGGACCACTAGA | 1069 |
| let-7g | TTTGCCTGATTCCAG GCTGAGGTAGTAGTT TGTACAGTTTGAGGG TCTATGATACCACCC GGTACAGGAGATAAC TGTACAGGCCACTGC CTTGCCAGGAACAG | 1347 | hypothetical miRNA-176 | TGAGGTAGTAGTTTGTACAGT | 285 |
| let-7g | TTTGCCTGATTCCAG GCTGAGGTAGTAGTT TGTACAGTTTGAGGG TCTATGATACCACCC GGTACAGGAGATAAC TGTACAGGCCACTGC CTTGCCAGGAACAG | 1347 | mir-1d | TGAGGTAGTAGTTTGTACAGTT | 1152 |
| mir-101_3 | ATCTGAGACTGAACT GCCCTTTTTCGGTTA TCATGGTACCGATGC TGTAGCTCTGAAAGG TACAGTACTGTGATA GCTGAAGAATGGCGG TGCCATC | 1348 | miR-200a | TACAGTACTGTGATAGCTGAAG | 1460 |
| mir-106 | ATGTCAAAGTGCTAA CAGTGCAGGTAGCTT TTTGAGTTCTACTGC AGTGCCAGCACTTCT TACAT | 1349 | miR-200a (RFAM-M. mu.) | CAAAGTGCTAACAGTGCAGGTA | 1461 |
| mir-17/mir-91 | GTCAGAATAATGTCA AAGTGCTTACAGTGC AGGTAGTGATGTGTG CATCTACTGCAGTGA GGGCACTTGTAGCAT TATGCTGAC | 1350 | mir-123/mir-126as | ACTGCAGTGAGGGCACTTCT | 1462 |
| mir-17/mir-91 | GTCAGAATAATGTCA AAGTGCTTACAGTGC AGGTAGTGATGTGTG CATCTACTGCAGTGA GGGCACTTGTAGCAT TATGCTGAC | 1350 | mir-227* (Kosik) | CAAAGTGCTTACAGTGCAGGTAG | 1181 |
| mir-17/mir-91 | GTCAGAATAATGTCA AAGTGCTTACAGTGC AGGTAGTGATGTGTG CATCTACTGCAGTGA GGGCACTTGTAGCAT TATGCTGAC | 1350 | miR-195 | CAAAGTGCTTACAGTGCAGGTAGT | 204 |
| mir-199b | CCAGAGGATACCTCC ACTCCGTCTACCCAG TGTTTAGACTACCTG TTCAGGACTCCCAAA TTGTACAGTAGTCTG CACATTGGTTAGGCT | 1351 | mir-226* (Kosik) | CCCAGTGTTTAGACTACCTGTTC | 1463 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GGGCTGGGTTAGACC CTCGG | | | | |
| mir-199b | CCAGAGGATACCTCC ACTCCGTCTACCCAG TGTTTAGACTACCTG TTCAGGACTCCCAAA TTGTACAGTAGTCTG CACATTGGTTAGGCT GGGCTGGGTTAGACC CTCGG | 1351 | mir-217 (rodent) | TACAGTAGTCTGCAGATTGGTT | 1118 |
| hypothetical miRNA 105 | GTTCCTTTTTCCTAT GCATATACTTCTTTG TGGATCTGGTCTAAA GAGGTATAGCGCATG GGAAGATGGAGC | 1352 | mir-324-3p_Ruvkun | AGAGGTATAGCGCATGGGAAGA | 1464 |
| hypothetical miRNA 105 | GTTCCTTTTTCCTAT GCATATACTTCTTTG TGGATCTGGTCTAAA GAGGTATAGCGCATG GGAAGATGGAGC | 1352 | miR-127 | TTCCTATGCATATACTTCTTT | 1132 |
| mir-211 | CTGCTTGGACCTGTG ACCTGTGGGCTTCCC TTTGTCATCCTTTGC CTAGGCCTCTGAGTG AGGCAAGGACAGCAA AGGGGGCTCAGTGG TCACCTCTACTGCAG A | 1353 | mir-244* (Kosik) | TTCCCTTTGTCATCCTTTGCCT | 1465 |
| mir-217 | AAACATAGTCATTAC AGTTTTTGATGTTGC AGATACTGCATCAGG AACTGACTGGATAAG ACTTAATCCCCATCA GTTCCTAATGCATTG CCTTCAGCATCTAAA CAA | 1354 | mir-224* (Kosik) | TACTGCATCAGGAACTGACTGGAT | 1466 |
| mir-224 (Sanger) | GGGCTTTTAAGTCAC TAGTGGTTCCGTTTA GTAGATGGTTTGTGC ATTGTTTCAAAATGG TGCCCTAGTGACTAC AAAGCCC | 1355 | mir-248* (Kosik) | TAAGTCACTAGTGGTTCCGTTTA | 1467 |
| mir-7_3 | AGGAGCGGAGTACCT GAGCCAGTGCTATGT GCAAGACTTGTGATT TTGTTGTTCTGATAT GATATGACAACAAGT CACAGCCAGCCTCAT ACCGTGGACTCCTAT CACCTT | 1356 | mir-138 | TGGAAGACTTGTCATTTTGTT | 1468 |
| mir-325 (Ruvkun) | ATATAGTGCTTGGTT CCTAGTAGGTGCTCA GTAAGTGTTTGTGAC ATAATTCGTTTATTG AGCACCTCCTATCAA TCAAGCACTGTGCTA GGCTCTGG | 1357 | mir-138_Ruvkun | CCTAGTAGGTGCTCAGTAAGTGT | 1469 |
| mir-326 (Ruvkun) | CTCATCTGTCTGTTG GGCTGGGGGCAGGGC CTTTGTGAAGGCGGG TTATGCTCAGATCGC CTCTGGGCCCTTCCT | 1358 | mir-181b | CCTCTGGGCCCTTCCTCCAG | 1263 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CCAGTCCCGAGGCAG ATTTA | | | | |
| mir-326 (Ruvkun) | CTCATCTGTCTGTTG GGCTGGGGGCAGGGC CTTTGTGAAGGCGGG TTATGCTCAGATCGC CTCTGGGCCCTTCCT CCAGTCCCGAGGCAG ATTTA | 1358 | miR-298 | CCTCTGGGCCCTTCCTCCAGT | 1470 |
| mir-329-1 (Ruvkun) | TGTTCGCTTCTGGTA CCGGAAGAGAGGTTT TCTGGGTCTCTGTTT CTTTGATGAGAATGA AACACACCCAGCTAA CCTTTTTTTCAGTAT CAAATCC | 1359 | mir-103 | AACACACCCAGCTAACCTTTTT | 1471 |
| mir-330 (Ruvkun) | GACCCTTTGGCGATC TCTGCCTCTCTGGGC CTGTGTCTTAGGCTC TTCAAGATCCAACGA GCAAAGCACAGGGCC TGCAGAGAGGTAGCG CTCTGCTC | 1360 | miR-134 (RFAM-Human) | GCAAAGCACAGGGCCTGCAGAGA | 1472 |
| mir-337 (Ruvkun) | CAGTGTAGTGAGAAG TTGGGGGGTGGGAAC GGCGTCATGCAGGAG TTGATTGCACAGCCA TTCAGCTCCTATATG ATGCCTTTCTTCACC CCCTTCA | 1361 | miR-146 (RFAM-Human) | TTCAGCTCCTATATGATGCCTTT | 1473 |
| mir-345 (Ruvkun) | ACCCAAGTCCAGGCC TGCTGACCCCTAGTC CAGTGCTTGTGGTGG CTACTGGGCCCTGAA CTAGGGGTCTGGAGA CCTGGGTTTGATCTC CACAGG | 1362 | miR-30e (RFAM-M. mu.) | TGCTGACCCCTAGTCCAGTGC | 1474 |
| mir-346 (Ruvkun) | TCTGTGTTGGGCGTC TGTCTGCCCGAGTGC CTGCCTCTCTGTTGC TCTGAAGGAGGCAGG GGCTGGGCCTGCAGC TGCCTGGGCAGAGCT GCTCCTTC | 1363 | miR-97 (Michael et al) | TGTCTGCCCGAGTGCCTGCCTCT | 1475 |
| mir-151* (Ruvkun) | AGCGCTTTCCTGCCC TCGAGGAGCTCACAG TCTAGTATGTCTCCT CCCTACTAGACTGAG GCTCCTTGAGGACAG GGATCGTCATACTCA CCTCC | 1364 | miR-193 | ACTAGACTGAGGCTCCTTGAGG | 1476 |
| mir-151* (Ruvkun) | AGCGCTTTCCTGCCC TCGAGGAGCTCACAG TCTAGTATGTCTCCT CCCTACTAGACTGAG GCTCCTTGAGGACAG GGATCGTCATACTCA CCTCC | 1364 | mir-340 (Ruvkun) | CTAGACTGAGGCTCCTTGAGG | 1477 |
| mir-151* (Ruvkun) | AGCGCTTTCCTGCCC TCGAGGAGCTCACAG TCTAGTATGTCTCCT CCCTACTAGACTGAG GCTCCTTGAGGACAG | 1364 | miR-299 (RFAM-M. mu.) | TCGAGGAGCTCACAGTCTAGTA | 1256 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GGATCGTCATACTCACCTCC | | | | |
| mir_34b (RFAM) | GTGCTCGGTTTGTAGGCAGTGTAATTAGCTGATTGTAGTGCGGTGCTGACAATCACTAACTCCACTGCCATCAAACAAGGCAC | 1365 | mir-331 (Ruvkun) | TAGGCAGTGTAATTAGCTGATTG | 1478 |
| glutamate receptor, ionotrophic, AMPA 3/ hypothetical miRNA-033 | TGGTGTGGCAACCCCTAAAGGCTCAGCATTAAGGTGGGTGGAATAATATAACAATATCCGTGTTGTTATAGTATTCCACCTACCCTGATGCATTTTGTTGTCGTTTTCTT | 1366 | miR-143 (Michael et al) | TGTTATAGTATTCCACCTACC | 1060 |
| mir-34 | GGCCAGCTGTGAGTAATTCTTTGGCAGTGTCTTAGCTGGTTGTTGTGAGTATTAGCTAAGGAAGCAATCAGCAAGTATACTGCCCTAGAAGTGCTGCACATTGTTGGGCC | 1367 | mir-138 | TGGCAGTGTCTTAGCTGGTTGT | 194 |
| mir-34 | GGCCAGCTGTGAGTAATTCTTTGGCAGTGTCTTAGCTGGTTGTTGTGAGTATTAGCTAAGGAAGCAATCAGCAAGTATACTGCCCTAGAAGTGCTGCACATTGTTGGGCC | 1367 | mir-30a | TGGCAGTGTCTTAGCTGGTTGTT | 1067 |
| mir-7_1/mir-7_1* | TTGGATGTTGGCCTAGTTCTGTGTGGAAGACTAGTGATTTTGTTGTTTTTAGATAACTAAAACGACAACAAATCACAGTCTGCCATATGGCACAGGCCA | 1368 | mir-191_Ruvkun | CAACAAATCACAGTCTGCCATA | 1070 |
| mir-7_1/mir-7_1* | TTGGATGTTGGCCTAGTTCTGTGTGGAAGACTAGTGATTTTGTTGTTTTTAGATAACTAAAACGACAACAAATCACAGTCTGCCATATGGCACAGGCCA | 1368 | mir-29b | TGGAAGACTAGTGATTTTGTT | 198 |
| mir-10b | GAGGTTGTAACGTTGTCTATATATACCCTGTAGAACCGAATTTGTGTGGTACCCACATAGTCACAGATTCGATTCTAGGGGAATATATGGTCGATGCAAAAACTTCA | 1369 | mir-210 | CCCTGTAGAACCGAATTTGTGT | 1071 |
| mir-10b | GAGGTTGTAACGTTGTCTATATATACCCTGTAGAACCGAATTTGTGTGGTACCCACATAGTCACAGATTCGATTCTAGGGGAATATATGGTCGATGCAAAAACTTCA | 1369 | miR-29b (RFAM-M. mu.) | TACCCTGTAGAACCGAATTTGT | 199 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
| --- | --- | --- | --- | --- | --- |
| mir-10b | GAGGTTGTAACGTTGTCTATATATACCCTGTAGAACCGAATTTGTGTGGTACCCACATAGTCACAGATTCGATTCTAGGCGAATATATGGTCGATGCAAAAACTTCA | 1369 | mir-34b (mouse) | TACCCTGTAGAACCGAATTTGTG | 1072 |
| mir-132 | GCCCCGCCCCCGCGTCTCCAGGGCAACCGTGGCTTTCGATTGTTACTGTGGGAACCGGAGGTAACAGTCTACAGCCATGGTCGCCCCGCAGCACGCCCACGC | 1370 | mir-130a | TAACAGTCTACAGCCATGGTCG | 1077 |
| mir-132 | GCCCCGCCCCCGCGTCTCCAGGGCAACCGTGGCTTTCGATTGTTACTGTGGGAACCGGAGGTAACAGTCTACAGCCATGGTCGCCCCGCAGCACGCCCACGC | 1370 | miR-196 (Tuschl) | TAACAGTCTACAGCCATGGTCGC | 206 |
| mir-108_1 | CCGATGCACACTGCAAGAACAATAAGGATTTTTAGGGGCATTATGACTGAGTCAGGAAACACAGCTGCCCCTGAAAGTCCCTCATTTTTCTTGCTGTCCTTGA | 1371 | mir-130 (Kosik) | ATAAGGATTTTTAGGGGCATT | 207 |
| mir-212 | CCCCGCCCGGGCAGCGCGCCGGCACCTTGGCTCTAGACTGCTTACTGCCCGGGCCGCCTTCAGTAACAGTCTCCAGTCACGGCCACCGACGCCTGGCCCCGCC | 1372 | miR-1 (RFAM) | TAACACTCTCCAGTCACGGCC | 210 |
| hypothetical miRNA 023 | AGATTTAATTAGCTCAGAGAAGAAATGTTGCTTGGGCAAGAGGACTTTTTAATTATCAGCTTGGATAAATTTGAAAATGTTGATGCCTAGGGGTTGAGTTAATTAAAACC | 26 | mir-143 | TGGGCAAGAGGACTTTTTAAT | 1079 |
| mir-214 | GGCCTGGCTGGACAGAGTTGTCATGTGTCTGCCTGTCTACACTTGCTGTGCAGAACATCCGCTCACCTGTACAGCAGGCACAGACAGGCAGTCACATGACAACCCAGCCT | 37 | mir-15b | ACAGCAGGCACAGACAGGCAG | 219 |
| hypothetical miRNA 040 | GCCAGCAAATAATGGCTGTTGTATTAGCTGCTTTTGATGATAGTATGAAAGAAGTATTAGCACTTGTCAACAAAACTGCTTACAACATAACATTAGCATGCATGGGCTGC | 43 | mir-145 | TGTCAACAAAACTGCTTACAA | 1092 |
| hypothetical miRNA 043 | CCCCTTATAGGCTCGTTTTGACAGGAAATCTTTGAGAGGCAGCGG | 1373 | miR-145 (Michael et al) | TGACAGGAAATCTTTGAGAGG | 1094 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CAGTGAGGTGCCCAG AGATTTCATCTCTCT TTTGCTTTAGGAAAT GCTGAGCATAAGGCT CC | | | | |
| mir-205 | CAGACAATCCATGGG TCCTCTTGTCCTTCA TTCCACCGGAGTCTG TCTTATGCCAACCAG ATTTCAGTGGAGTGA AGCTCAGGAGGCATG GAGCTG | 1374 | mir-101 | TCCTTCATTCCACCGGAGTCTG | 224 |
| mir-33a | ACCTCCTGGCGGGCA GCTGTGGTGCATTGT AGTTGCATTGCATGT TCTGGCAATACCTGT GCAATGTTTCCACAG TGCATCACGGAGGCC TGCC | 1375 | miR-29b (RFAM-M. mu.) | GTGCATTGTAGTTGCATTG | 227 |
| mir-196_2 | TGCTTGCTCAGCTGA TCTGTGGCTTAGGTA GTTTCATGTTGTTGG GATTGAGTTTTGAAC TCGGCAACAAGAAAC TGCCTGAGTTACATC AGTCGGTTTTCGTCG AGGGC | 1376 | mir-7-1*_Ruvkun | TAGGTAGTTTCATGTTGTTGG | 1097 |
| mir-196_2 | TGCTTGCTCAGCTGA TCTGTGGCTTAGGTA GTTTCATGTTGTTGG GATTGAGTTTTGAAC TCGGCAACAAGAAAC TGCCTGAGTTACATC AGTCGGTTTTCGTCG AGGGC | 1376 | mir-148a | TAGGTAGTTTCATGTTGTTGGG | 228 |
| hypothetical miRNA 055 | TTGAACATGATGAAT GATTGGAGTCAGAGA AGCGGCGTGATAGAT GGCAGCACCTTGGCT CCATTGCATGCCCTA TTGATTCTCCTTCTT TATTACTCCTACAAC CCAGC | 1377 | mir-122a | TTGCATGCCCTATTGATTCTC | 1099 |
| hypothetical miRNA 058 | TATCATCTTGTCAGA TGCTTAATGTTCTTC CTCCTGTCACTTTGG ATAGGCCCAATTTGT AGAATACTGCACGGG TAAAGGATGACAATT AACAGTGACA | 1378 | miR-122a, b (Tuschl) | TGTCAGATGCTTAATGTTCTT | 1102 |
| mir-218_1 | GTGATAATGGAGCGA GATTTTCTGTTGTGC TTGATCTAACCATGT GCTTGCGAGGTATGA GAAAAACATGGTTCC GTCAAGCACCATGGA ACGTCACGCAGCTTT CTACA | 1379 | mir-140 | TTGTGCTTGATCTAACCATGT | 234 |
| mir-218_1 | GTGATAATGGAGCGA GATTTTCTGTTGTGC TTGATCTAACCATGT GCTTGCGAGGTATGA GAAAAACATGGTTCC GTCAAGCACCATGGA | 1379 | mir-196 | TTGTGCTTGATCTAACCATGTG | 1103 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ACGTCACGCAGCTTT CTACA | | | | |
| mir-222 | CCCTCAGTGGCTCAG TAGCCAGTGTAGATC CTGTCTTTGGTAATC AGCAGCTACATCTGG CTACTGGGTCTCTGG TGGCATCATCTAGCT | 1380 | miR-200b (Michael et al) | AGCTACATCTGGCTACTGGGTCT | 1107 |
| mir-222 | CCCTCAGTGGCTCAG TAGCCAGTGTAGATC CTGTCTTTGGTAATC AGCAGCTACATCTGG CTACTGGGTCTCTGG TGGCATCATCTAGCT | 1380 | let-7i | AGCTACATCTGGCTACTGGGTCTC | 239 |
| mir-128b | CCCGGCAGCCACTGT GCAGTGGGAAGGGGG GCCGATGCACTGTAA GAGAGTGAGTAGCAG GTCTCACAGTGAACC GGTCTCTTTCCCTAC TGTGTCAAACTCCTA A | 1381 | mir-142 | TCACAGTGAACCGGTCTCTTT | 1073 |
| mir-128b | CCCGGCAGCCACTGT GCAGTGGGAAGGGGG GCCGATGCACTGTAA GAGAGTGAGTAGCAG GTCTCACAGTGAACC GGTCTCTTTCCCTAC TGTGTCAAACTCCTA A | 1381 | hypothetical miRNA-023 | TCACAGTGAACCGGTCTCTTTC | 242 |
| mir-219_2 | GGGCCCTGAACTCAG GGGCTTCGCCACTGA TTGTCCAAACGCAAT TCTTGTACGAGTCTG CGGCCAACCGAGAAT TGTGGCTGGACATCT GTGGTTGAGCTCCGG GC | 1382 | mir-30b_Ruvkun | TGATTGTCCAAACGCAATTCT | 271 |
| hypothetical miRNA 070 | GATGCTTGATGTTGT CAGACTGAAGAATCT CTACAGGTAAGTGTG TGGTTTCTTCAGTGA CATCACATTTGCCTG CAGAGATTTCCCAGT CTGCCA | 1383 | mir-19b | TCACATTTGCCTGCAGAGATT | 1109 |
| mir-129_2 | CTGCCTTTCGCGAAT CTTTTTGCGGTCTGG GCTTGCTGTACATAA CTCAATAGCCGGAAG CCCTTACCCCAAAAA GCATTCGCGGAGGGC GCGCTCG | 1384 | miR-196 (Tuschl) | AAGCCCTTACCCCAAAAAGCAT | 1110 |
| mir-129_2 | CTGCCTTTCGCGAAT CTTTTTGCGGTCTGG GCTTGCTGTACATAA CTCAATAGCCGGAAG CCCTTACCCCAAAAA GCATTCGCGGAGGGC GCGCTCG | 1384 | mir-128 (Kosik) | CTTTTTGCGGTCTGGGCTTGC | 243 |
| mir-129_2 | CTGCCTTTCGCGAAT CTTTTTGCGGTCTGG GCTTGCTGTACATAA CTCAATAGCCGGAAG | 1384 | miR-142-as | CTTTTTGCGGTCTGGGCTTGCT | 1111 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CCCTTACCCCAAAAA GCATTCGCGGAGGGC GCGCTCG | | | | |
| mir-133b | GCCCCCTGCTCTGGC TGGTCAAACGGAACC AAGTCCGTCTTCCTG AGAGGTTTGGTCCCC TTCAACCAGCTACAG CAGGGCTGGCAA | 1385 | miR-142as (Michael et al) | TTGGTCCCCTTCAACCAGCTA | 244 |
| hypothetical miRNA 075 | AGCGCAGCTTTAATT ACTCATGCTGCTGGT TAAAATATTAATGGG GCACAGAGTGTTGCA TGCTCATTTCTGTTG ATTTTAATTAGCAG TAATTCATTTTGCAC AAAGC | 78 | let-7f | TGGTTAAAATATTAATGGGGC | 1112 |
| hypothetical miRNA 079 | CCTGCCTGCTTCTGT GTGATATGTTTGATA TTGGGTTGTTAAATT ATGAACCAACTGAAT GTCAAGCATACTCTC ACAGCAG | 1386 | let-7f (Michael et al) | TGATATGTTTGATATTGGG | 1117 |
| mir-204 | GGCTACAGTCCTTCT TCATGTGACTCGTGG ACTTCCCTTTGTCAT CCTATGCCTGAGAAT ATATGAAGGAGGCTG GGAAGGCAAAGGGAC GTTCAATTGTCATCA CTGGC | 1387 | let-7d_Ruvkun | TTCCCTTTGTCATCCTATGCCT | 251 |
| mir-204 | GGCTACAGTCCTTCT TCATGTGACTCGTGG ACTTCCCTTTGTCAT CCTATGCCTGAGAAT ATATGAAGGAGGCTG GGAAGGCAAAGGGAC GTTCAATTGTCATCA CTGGC | 1387 | miR-10b (Tuschl) | TTCCCTTTGTCATCCTATGCCTG | 1121 |
| mir-213/ mir-181a_2 | AGGTTGCTTCAGTGA ACATTCAACGCTGTC GGTGAGTTTGGAATT CAAATAAAAACCATC GACCGTTGATTGTAC CCTATAGCTAACCAT CATCTACTCCA | 1388 | mir-137 | AACATTCAACGCTGTCGGTGAG | 1096 |
| mir-213/ mir-181a_2 | AGGTTGCTTCAGTGA ACATTCAACGCTGTC GGTGAGTTTGGAATT CAAATAAAAACCATC GACCGTTGATTGTAC CCTATAGCTAACCAT CATCTACTCCA | 1388 | hypothetical miRNA-043 | AACATTCAACGCTGTCGGTGAGT | 223 |
| mir-213/ mir-181a_2 | AGGTTGCTTCAGTGA ACATTCAACGCTGTC GGTGAGTTTGGAATT CAAATAAAAACCATC GACCGTTGATTGTAC CCTATAGCTAACCAT CATCTACTCCA | 1388 | let-7f (Michael et al) | ACCATCGACCGTTGATTGTACC | 253 |
| hypothetical miRNA 090 | CAGCGATACATTAAT GCTCATCTGGCTCTG CAAATCTTACCGTTT | 1389 | mir-26a | TAGGCCAAATGGCGCATCAAT | 1124 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GCTTAGGCCAAATGG CGCATCAATGACTAT CGCTCTTTACAAAAC TCTTGAATCAGTGTT ATGTAA | | | | |
| mir-138_2 | TTCTGGTATGGTTGC TGCAGCTGGTGTTGT GAATCAGGCCGACGA GCAGCGCATCCTCTT ACCCGGCTATTTCAC GACACCAGGGTTGCA CCCTACCCATCCTC | 1390 | mir-92 | AGCTGGTGTTGTGAATC | 256 |
| mir-138_2 | TTCTGGTATGGTTGC TGCAGCTGGTGTTGT GAATCAGGCCGACGA GCAGCGCATCCTCTT ACCCGGCTATTTCAC GACACCAGGGTTGCA CCCTACCCATCCTC | 1390 | miR-27* (Michael et al) | AGCTGGTGTTGTGAATCAGGCCG | 1127 |
| mir-196_1 | TGGAGCTGCTGAGTG AATTAGGTAGTTTCA TGTTGTTGGGCCTGG ATTTCTGAACACAAC GACATTAAACCACCC GACTCACGGCAGCTA CTGCTCC | 1391 | miR-29b (RFAM-Human) | TAGGTAGTTTCATGTTGTTGG | 1097 |
| mir-196_1 | TGGAGCTGCTGAGTG AATTAGGTAGTTTCA TGTTGTTGGGCCTGG ATTTCTGAACACAAC GACATTAAACCACCC GACTCACGGCAGCTA CTGCTCC | 1391 | mir-7 | TAGGTAGTTTCATGTTGTTGGG | 228 |
| mir-199a_2 | GGAAGCTTCAGGAGA TCCTGCTCCGTCGCC CCAGTGTTCAGACTA CCTGTTCAGGACAAT GCCGTTGTACAGTAG TCTGCACATTGGTTA GACTGGGCAAGGG | 1392 | miR-202 (mouse) | CCCAGTGTTCAGACTACCTGTT | 1128 |
| mir-199a_2 | GGAAGCTTCAGGAGA TCCTGCTCCGTCGCC CCAGTGTTCAGACTA CCTGTTCAGGACAAT GCCGTTGTACAGTAG TCTGCACATTGGTTA GACTGGGCAAGGG | 1392 | mir-15a | CCCAGTGTTCAGACTACCTGTTC | 259 |
| mir-199a_2 | GGAAGCTTCAGGAGA TCCTGCTCCGTCGCC CCAGTGTTCAGACTA CCTGTTCAGGACAAT GCCGTTGTACAGTAG TCTGCACATTGGTTA GACTGGGCAAGGG | 1392 | mir-211 (rodent) | TACAGTAGTCTGCACATTCGTT | 1118 |
| mir-181b_1 | AAAGGTCACAATCAA CATTCATTGCTGTCG GTGGGTTGAACTGTG TAGAAAAGCTCACTG AACAATGAATGCAAC TGTGGCCCCGCTT | 1393 | mir-16 | AACATTCATTGCTGTCGGTGGGTT | 260 |
| hypothetical miRNA 101 | GTATATTCAAGGACA GGCCATTGACAGTCA ATTAACAAGTTTGAT | 1394 | miR-26a (Michael et al) | TGACAGTCAATTAACAAGTTT | 1130 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TGGTATGTCAACTCA TTCTTTTGAATTGTT AATAGTATGTTAATA GCATTCGTTTCTTTG TGCAG | | | | |
| hypothetical miRNA 111 | CTCTGGCCTCCGCTT CCTCCTCCTCCGACT CGGACGCCGGCGGAG CCTCCCCGCCCCCGC GAAAGAAGCCCCGAG CCTCGGCGGCGGAGG GAGCAGGAGAGCCCG GGGC | 1395 | mir-127_Ruvkun | TTCCTCCTCCTCCGACTCGGA | 1135 |
| mir-218_2 | GACCAGTTGCCGCGG GGCTTTCCTTTGTGC TTGATCTAACCATGT GGTGGAACGATGGAA ACGGAACATGGTTCT GTCAAGCACCGCGGA AAGCATCGCTCTCTC CTGCA | 1396 | mir-33a | TTGTGCTTGATCTAACCATGT | 234 |
| mir-218_2 | GACCAGTTGCCGCGG GGCTTTCCTTTGTGC TTGATCTAACCATGT GGTGGAACGATGGAA ACGGAACATGGTTCT GTCAAGCACCGCGGA AAGCATCGCTCTCTC CTGCA | 1396 | mir-24 | TTGTGCTTGATCTAACCATGTG | 1103 |
| mir-148b | TTAGCATTTGAGGTG AAGTTCTGTTATACA CTCAGGCTGTGGCTC TGAAAGTCAGTGCAT CACAGAACTTTGTCT CGAAAGCTTTCTAGC AGC | 1397 | mir-30d | TCAGTGCATCACAGAACTTTGT | 272 |
| mir-216 | GATGGCTATGAGTTG GTTTAATCTCAGCTG GCAACTGTGAGATGT CCCTATCATTCCTCA CAGTGGTCTCTGGGA TTATGCTAAACAGAG CAATTTCCT | 1398 | mir-30d_Ruvkun | TAATCTCAGCTGGCAACTGTG | 274 |
| hypothetical miRNA 137 | GTTCAACATAAGCAA ACAGATTGTAAACTG GCTGATAATTTTTGT ACTGACAATGTCATT TACAGCTGTCAGCCT TTCGTCTGTCTTGTT TGCTTTATTCAAATA TGAAC | 1399 | miR-136 | TAAACTGGCTGATAATTTTTG | 1141 |
| hypothetical miRNA 138 | CCCTCCAATGTCTGA TTAATCAAGCCTGCA AACAGCTTATTTCTT TTTGCCTGCATGCAA GTATGAAAATGAGAT TCTGGGAGCCGAACA TTGTGCAGATTTGTT CATTC | 1400 | miR-154 | TGCAAGTATGAAAATGAGATT | 1142 |
| mir-210 | GGCAGTCCCTCCAGG CTCAGGACAGCCACT GCCCACCGCACACTG CGTTGCTCCGGACCC ACTGTGCGTGTGACA | 1401 | let-7c | CTGTGCGTGTGACAGCGGCTG | 277 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GCGGCTGATCTGTCC CTGGGCAGCGCGA | | | | |
| mir-223 | CTGCAGTGTCACGCT CCGTGTATTTGACAA GCTGAGTTGGACACT CTGTGTGGTAGAGTG TCAGTTTGTCAAATA CCCCAAGTGTGGCTC ATGC | 1402 | let-7c_Ruvkun | TGTCAGTTTGTCAAATACCCC | 279 |
| hypothetical miRNA 153 | TGTTGAATGCAAGCA GATGCTGATAATATC AGAAGTCACAGCATA ATTTTTTTGATCAAA GGGCTCAAGTGAGCC TGATGAAGCATGCAT CTTGCTCGTCTTTGA TAAA | 1403 | miR-149 | TGCAAGCAGATGCTGATAATA | 1145 |
| hypothetical miRNA 154 | CCTGCAGTGATGCTT CATGAGCAAATCACA TGATGTCAGAATGGT ATGGTTTCGATTTAA TCAAGAAAGAGATTA AAGTGGATGTGTGTT ATTTTCAACTTCGCC GCAGC | 1404 | mir-30c | TTAAAGTGGATGTGTGTTATT | 1146 |
| mir-135_1 | GCCCCAGGCCTCACT GTTCTCTATGGCTTT TTATTCCTATGTGAT TCTATTGCTCGCTCA TATAGGGATTGGAGC CGTGGCGTACGG | 1405 | hypothetical miRNA-101 | TATGGCTTTTTATTCCTATGTGA | 1149 |
| mir-135_1 | GCCCCAGGCCTCACT GTTCTCTATGGCTTT TTATTCCTATGTGAT TCTATTGCTCGCTCA TATAGGGATTGGAGC CGTGGCGTACGG | 1405 | let-7e | TATGGCTTTTTATTCCTATGTGAT | 283 |
| non-coding RNA in rhabdo-myosarcoma/ mir-135_2 | ACCAAGATAAATTCA CTCTAGTGCTTTATG GCTTTTTATTCCTAT GTGATCGTAATAAAG TCTCATGTAGGGATG GAAGCCATGAAATAC ATTGTGAAAATTCAT CAACT | 1406 | mir-181b | TATGGCTTTTTATTCCTATGTGA | 1149 |
| non-coding RNA in rhabdo-myosarcoma/ mir-135_2 | ACCAAGATAAATTCA CTCTAGTGCTTTATG GCTTTTTATTCCTAT GTGATCGTAATAAAG TCTCATGTAGGGATG GAAGCCATGAAATAC ATTGTGAAAATTCAT CAACT | 1406 | miR-155/ hypothetical miRNA-071 | TATGGCTTTTTATTCCTATGTGAT | 283 |
| hypothetical miRNA 170 | GAATGTATGATCTTG CTCTAACACTTGGCC AGACCTGTGTGACCC ACCGCTAGTGCCTGA AGTCGACAGACAATT CTGCCAAGGTAACTG AGAATCATTAAGCAT CCTGC | 1407 | mir-30c_Ruvkun | TGATCTTGCTCTAACACTTGG | 1157 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| glutamate receptor, ionotropic, AMPA 2/ hypothetical miRNA-171 | CACCCTGTCTGACAAGTATGTTTTATCGTTTCAAGAAATGCGGTTAACCTCGCAGTACTAAAACTGAATGAACAAGGCCTGTTGGACAAATTGAAAAACAAATGGTGGTA | 174 | miR-99b | TGACAAGTATGTTTTATCGTT | 1158 |
| hypothetical miRNA 176 | TGGAAGGAAAATAGGAGTTTGATATGACATATTGTGTGTCTCAGCAAGACTCATAAATAATTTTGACAAGTTTTTGTATGCATGGGAAAGTCCTTGATTCAGCCTCCCAT | 179 | miR-125a | TAGGAGTTTGATATGACATAT | 1163 |
| hypothetical miRNA 179 | AATGCCAGCGAGTTTGAAAGGCACTTTGTCCAATTAGAAGTGTGGGGAAAATATCCATCCTGTCTGTGACAAAGATGAAGCACTTCTTTCAAAAG | 1408 | mir-125b | TGAAAGGCACTTTGTCCAATT | 1166 |
| hypothetical miRNA 181 | TGTGCACCTCACCTGCTCTGGAAGTAGTTTGCTAGCTCTGATGCTTCATGGTTCAGACTCCTCAGGTGCACGATTAAATTTCCAGAGTTGGTGAACATGGCGCCACATG | 1409 | mir-221 | TCACCTGCTCTGGAAGTAGTT | 1167 |
| mir-181c | TTGCCAAGGGTTTGGGGGAACATTCAACCTGTCGGTGAGTTTGGGCAGCTCAGACAAACCATCGACCGTTGAGTGGACCCCGAGGCCTGGAACTCCCA | 1410 | mir-133a | AACATTCAACCTGTCGGTGAGT | 290 |
| mir-100_1 | CCTGTTGCCACAAACCCGTAGATCCGAACTTGTGCTGATTCTGCACACAAGCTTGTGTCTATAGGTATGTGTCTGTTAGG | 1411 | let-7b | AACCCGTAGATCCGAACTTGTG | 275 |
| mir-103_1 | TACTGCCCTCGGCTTCTTTACAGTGCTGCCTTGTTGCATATGGATCAAGCAGCATTGTACAGGGCTATGAAGGCATTG | 950 | mir-29a | AGCAGCATTGTACAGGGCTATGA | 225 |
| mir-107 | CTCTGTGCTTTCAGCTTCTTTACAGTGTTGCCTTGTGGCATGGAGTTCAAGCAGCATTGTACAGGGCTATCAAAGCACAGA | 1412 | mir-141 | AGCAGCATTGTACAGGGCTATCA | 229 |
| mir-19a | CCTCTGTTAGTTTTGCATAGTTGCACTACAAGAAGAATGTAGTTGTGCAAATCTATGCAAAACTGATGGTGGCCTG | 1413 | mir-20 | TGTGCAAATCTATGCAAAACTGA | 268 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-19b_1 | TCTATGGTTAGTTTT GCAGGTTTGCATCCA GCTGTATAATATTCT GCTGTGCAAATCCAT GCAAAACTGACTGTG CT | 1414 | mir-21 | AGTTTTGCAGGTTTGCATCCAGC | 1179 |
| mir-19b_1 | TCTATGGTTAGTTTT GCAGGTTTGCATCCA GCTGTATAATATTCT GCTGTGCAAATCCAT GCAAAACTGACTGTG GT | 1414 | mir-223 | TGTGCAAATCCATGCAAAACTGA | 241 |
| mir-92_1 | CTTTCTACACAGGTT GGGATTTGTCGCAAT GCTGTGTTTCTCTGT ATGGTATTGCACTTG TCCCGGCCTGTTGAG TTTGG | 1415 | hypothetical miRNA-090 | TATTGCACTTGTCCCGGCCTG | 1182 |
| mir-92_1 | CTTTCTACACAGGTT GGGATTTGTCGCAAT GCTGTGTTTCTCTGT ATGGTATTGCACTTG TCCCGGCCTGTTGAG TTTGG | 1415 | miR-9 | TATTGCACTTGTCCCGGCCTGT | 216 |
| mir-98 | GTGAGGTAGTAAGTT GTATTGTTGTGGGGT AGGGATTTTAGGCCC CAGTAAGAAGATAAC TATACAACTTACTAC TTTCC | 1416 | mir-131 | TGAGGTAGTAAGTTGTATTGTT | 257 |
| mir-104 (Mourelatos) | AAATGTCAGACAGCC CATCGACTGCTGTTG CCATGAGATTCAACA GTCAACATCAGTCTG ATAAGCTATCCGACA AGG | 1417 | mir-221 (RFAM-mmu) | TCAACATCAGTCTGATAAGCTA | 335 |
| mir-27 (Mourelatos) | CCTGAGGAGCAGGGC TTAGCTGCTTGTGAG CAAGGTCCACAGCAA AGTCGTGTTCACAGT GGCTAAGTTCCGCCC CC | 1418 | mir-213 | TTCACAGTGGCTAAGTTCC | 1186 |
| mir-27 (Mourelatos) | CCTGAGGAGCAGGGC TTAGCTGCTTGTGAG CAAGGTCCACAGCAA AGTCGTGTTCACAGT GGCTAAGTTCCGCCC CC | 1418 | mir-222 (RFAM-mmu) | TTCACAGTGGCTAAGTTCCGC | 1187 |
| mir-27 (Mourelatos) | CCTGAGGAGCAGGGC TTAGCTGCTTGTGAG CAAGGTCCACAGCAA AGTCGTGTTCACAGT GGCTAAGTTCCGCCC CC | 1418 | mir-203 | TTCACAGTGGCTAAGTTCCGCC | 1188 |
| mir-31 | CTCCTGTAACTCGGA ACTGGAGAGGAGGCA AGATGCTGGCATAGC TGTTGAACTCAGAAC CTGCTATGCCAACAT ATTGCCATCTTTCCT GTCTGACAGCAGC | 1419 | mir-178 (Kosik) | AGGCAAGATGCTGGCATAGCTG | 1197 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-31 | CTCCTGTAACTCGGAACTGGAGAGGAGGCAAGATGCTGGCATAGCTGTTGAACTGAGAACCTGCTATGCCAACATATTGCCATCTTTCCTGTCTGACAGCAGC | 1419 | miR-203 (RFAM-M. mu.) | GGCAAGATGCTGGCATAGCTG | 1198 |
| mir-32 | TCTGCTTGCTCTGGTGGAGATATTGCACATTACTAAGTTGCATGTTGTCACGGCCTCAATGCAATTTAGTGTGTGTGATATTTTCACATGAGTGCATGCA | 1420 | let-7g | TATTGCACATTACTAAGTTGC | 1199 |
| mir_186 | ATTGCTTACAACTTTCCAAAGAATTCTCCTTTTGGGCTTTCTCATTTTATTTTAAGCCCTAAGGTGAATTTTTTGGGAAGTTTGAGCT | 1421 | miR-326 (Ruvkun) | CAAAGAATTCTCCTTTTGGGCTT | 1208 |
| mir_191 | CCAATGGCTGGACAGCGGGCAACGGAATCCCAAAACCAGCTGTTCTCTCCAGAGCATTCCAGCTGCACTTGGATTTCGTTCCTGCTCTCCTGCCTGAGC | 1422 | mir-329 (mouse) | CAACGGAATCCCAAAAGCAGCT | 1210 |
| mir_191 | CCAATGGCTGGACAGCGGGCAACGGAATCCCAAAAGCAGCTGTTGTCTCCAGAGCATTCCAGCTGCACTTCCATTTCGTTCCTGCTCTCCTGCCTGAGC | 1422 | miR-27a (RFAM-Human) | CAACGGAATCCCAAAAGCAGCTGT | 1211 |
| mir_195 | CCTGGCTCTAGCAGCACAGAAATATTCGCATGGGGAAGTGAGTCTGCCAATATTGGCTGTGCTGCTCCAGGCAGGGTGGTG | 1423 | mir-330 (rodent) | TAGCAGCACAGAAATATTGGC | 1216 |
| mir_193 | GGGAGCTGAGAGCTGGGTCTTTGCGGGCAAGATGAGAGTGTCAGTTCAACTGGCCTACAAAGTCCCAGTCCTCGGTCCCC | 1424 | mir-337 (rodent) | AACTGGCCTACAAAGTCCCAG | 1217 |
| mir_188 | TCCCTGCTCCCTCTCTCACATCCCTTGCATGGTGGAGGGTGAGCTCTCTGAAAACCCCTCCCACATGCAGGGTTTGCAGGATGGTGAGC | 1425 | mir-345 (rodent) | CATCCCTTGCATCGTGGAGGGT | 1219 |
| mir_208 | TTCCTTTGACGGGTGAGCTTTTGGCCCGGGTTATACCTGACACTCACGTATAAGACGAGCAAAAAGCTTGTTGGTCAGAGGAG | 1426 | mir-346 (mouse) | ATAAGACGAGCAAAAAGCTTGT | 1222 |
| mir_139 | GGACAGGCGCAGGTGTATTCTACAGTGCACGTGTCTCCAGTGTGGCTCGGAGGCTGGAGA | 1427 | mir-151* (Ruvkun) | TCTACAGTGCACGTGTCT | 1223 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CGCGGCCCTGTTGGA GTAACAACTGAAGCC AGAGTCT | | | | |
| mir-200b | GTGGCCATCTTACTG GGCAGCATTGGATAG TGTCTGATCTCTAAT ACTGCCTGGTAATGA TGACGGCGGAG | 1428 | mir-151 (rodent) | CTCTAATACTGCCTGGTAATGATG | 1224 |
| mir-200b | GTGGCCATCTTACTG GGCAGCATTGGATAG TGTCTGATCTCTAAT ACTGCCTGGTAATGA TGACGGCGGAG | 1428 | mir-216 | TAATACTGCCTGGTAATGATGA | 1225 |
| mir-200b | GTGGCCATCTTACTG GGCAGCATTGGATAG TGTCTGATCTCTAAT ACTGCCTGGTAATGA TGACGGCGGAG | 1428 | mir-219 | TAATACTGCCTGGTAATGATGAC | 1226 |
| mir-200a | GGGCCTCTGTGGGCA TCTTACCGGACAGTG CTGGATTTCTTGGCT TGACTCTAACACTGT CTGGTAACGATGTTC AAAGGTGACCC | 1429 | mir-181a | TAACACTGTCTGGTAACGATG | 1227 |
| mir-200a | GGGCCTCTGTGGGCA TCTTACCGGACAGTG CTGGATTTCTTGGCT TGACTCTAACACTGT CTGGTAACGATGTTC AAAGGTGACCC | 1429 | mir-151L (rodent) | TAACACTGTCTGGTAACGATGT | 1228 |
| mir-227* (Kosik)/mir-226* (Kosik) | TGACTATGCCTCCTC GCATCCCCTAGGGCA TTGGTGTAAAGCTGG AGACCCACTGCCCCA GGTGCTGCTGGGGGT TGTAGTCT | 1430 | mir-191 | ACTGCCCCAGGTGCTGCTGG | 1231 |
| mir-227* (Kosik)/mir-226* (Kosik) | TGACTATGCCTCCTC GCATCCCCTAGGGCA TTGGTGTAAAGCTGG AGACCCACTGCCCCA GGTGCTGCTGGGGGT TGTAGTCT | 1430 | hypothetical miRNA-058 | CCACTGCCCCAGGTGCTGCTGG | 1232 |
| mir-227* (Kosik)/mir-226* (Kosik) | TGACTATGCCTCCTC GCATCCCCTAGGGCA TTGGTGTAAAGCTGG AGACCCACTGCCCCA GGTGCTGCTGGGGGT TGTAGTCT | 1430 | hypothetical miRNA-055 | CGCATCCCCTAGGGGATTGGTGT | 1233 |
| mir-244* (Kosik) | GTCCTCCCCAACAAT ATCCTGGTGCTGAGT GGGTGCACAGTGACT CCAGCATCAGTGATT TTGTTGAAGAGGGCA GCTGCCA | 1431 | mir-218 | TCCAGCATCAGTGATTTTGTTGA | 1234 |
| mir-224* (Kosik) | TGGTACTTGGAGAGA GGTGGTCCGTGGCGC GTTCGCTTCATTTAT GGCGCACATTACACG GTCGACCTCTTTGCG GTATCTA | 1432 | mir-253* (Kosik) | CCACATTACACGGTCGACCTCT | 1235 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-248* (Kosik) | GAAAATGGGCTCAAG GTGAGGGGTGCTATC TGTGATTGAGGGACA TGGTCAATGGAATTG TCTCACACAGAAATC GCACCCGTCACCTTG GCCT | 1433 | mir-222 | TCTCACACAGAAATCGCACCGGTC | 1236 |
| mir-138_3 | ATGGTGTTGTGGGAC AGCTGGTGTTGTGAA TCAGGCCGTTGCCAA TCAGAGAACGGCTAC TTCACAACACCAGGG CCACAC | 1434 | mir-19b* (Michael et al) | AGCTGGTGTTGTGAATC | 256 |
| mir-138_3 | ATGGTGTTGTGGGAC AGCTGGTGTTGTGAA TCAGGCCGTTGCCAA TCAGAGAACGGCTAC TTCACAACACCAGGG CCACAC | 1434 | mir-27b | AGCTGGTGTTGTGAATCAGGCCG | 1127 |
| mir-181b_2 | ATGGCTGCACTCAAC ATTCATTGCTGTCGG TGGGTTTGAATGTCA ACCAACTCACTGATC AATGAATGCAAACTG CGGGCCAAA | 1435 | mir-15_Ruvkun | AACATTCATTGCTGTCGGTGGGTT | 260 |
| mir-103_2 | GTGCTTTCAGCTTCT TTACAGTGCTGCCTT GTAGCATTCAGGTCA AGCAGCATTGTACAG GGCTATGAAAGAACC A | 1436 | miR-101 (RFAM-Human) | AGCAGCATTGTACAGGGCTATGA | 225 |
| mir-134 (Sanger) | CAGGGTGTGTGACTG GTTGACCAGAGGGGC GTGCACTCTGTTCAC CCTGTGGGCCACCTA GTCACCAACCCTC | 1437 | mir-129 | TGTGACTGGTTGACCAGAGGG | 1240 |
| mir-146 (Sanger) | TGTGTATCCCCAGCT CTGAGAACTGAATTC CATGGGTTATATCAA TGTCAGACCTGTGAA ATTCAGTTCTTCAGC TGGGATAGCTCTGTC ATC | 1438 | mir-129as/mir-258* (Kosik) | TGAGAACTGAATTCCATGGGTT | 1241 |
| mir-30e (RFAM/mmu) | TGGGCAGTCTTTGCT ACTGTAAACATCCTT GACTGGAAGCTGTAA GGTGTTGAGAGGAGC TTTCAGTCGGATGTT TACAGCGGCAGGCTG CCAC | 1439 | miR-129b (RFAM-Human) | TGTAAACATCCTTGACTGGA | 1243 |
| mir-30e (RFAM/mmu) | TGGGCAGTCTTTGCT ACTGTAAACATCCTT GACTGGAAGCTGTAA GGTGTTGAGAGGAGC TTTCAGTCGGATGTT TACAGCGGCAGGCTG CCAC | 1439 | miR-135 (RFAM-Human) | TGTAAACATCCTTGACTGGAAG | 1244 |
| mir-299 (RFAM/mmu) | CGGTACTTGAAGAAA TGGTTTACCGTCCCA CATACATTTTGAGTA TGTATGTGGGACGGT | 1440 | mir-133b | TGGTTTACCGTCCCACATACAT | 1246 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | AAACCGCTTCTTGGT ATCC | | | | |
| mir-340 (Ruvkun) | TGTACTTGGTGTGAT TATAAAGCAATGAGA CTGATTGTCATATGT CGTTTGTGGGATCCG TCTCAGTTACTTTAT AGCCATACCTGGTAT C | 1441 | miR-188 | TCCGTCTCAGTTACTTTATAGCC | 1257 |
| mir-331 (Ruvkun) | TGTTTGGGTTTGTTC TAGGTATGGTCCCAG GGATCCCAGATCAAA CCAGGCCCCTGGGCC TATCCTAGAACCAAC CTAA | 1442 | miR-208 | GCCCCTGGGCCTATCCTAGAA | 1258 |
| mir-187 | CCTCAGGCTACAACA CAGGACCCGGGCGCT GCTCTGACCCCTCGT GTCTTGTGTTGCAGC CGGAGGGACGCAGGT C | 1443 | miR-199-s | TCGTGTCTTGTGTTGCAGCCG | 1270 |
| mir-187 | CCTCAGGCTACAACA CACGACCCGGGCGCT GCTCTGACCCCTCGT GTCTTGTGTTGCAGC CGGAGGGACGCAGGT C | 1443 | let-7b_Ruvkun | TCGTGTCTTGTGTTGCAGCCGG | 276 |
| miR-201 | TACCTTACTCAGTAA GGCATTGTTCTTCTA TATTAATAAATGAAC AGTGCCTTTCTGTGT AGGGTA | 1444 | miR-187 (RFAM-Human) | TACTCAGTAAGGCATTGTTCT | 1479 |
| miR-207 | AAGGCAGGGGTGAGG GGCTGCGGGACGAGC CGGGCGGAGGCTGCG GCTTGCGCTTCTCCT GGCTCTCCTCCCTCT CTTT | 1445 | miR-201 | GCTTCTCCTGGCTCTCCTCCCTC | 1480 |
| miR-291 | CCTATGTAGCGGCCA TCAAAGTGGAGGCCC TCTCTTGAGCCTGAA TGAGAAAGTGCTTCC ACTTTGTGTGCCACT GCATGGG | 1446 | miR-291 | AAAGTGCTTCCACTTTGTGTGCC | 1481 |
| miR-291 | CCTATGTAGCGGCCA TCAAAGTGGAGGCCC TCTCTTGAGCCTGAA TGAGAAAGTGCTTCC ACTTTGTGTGCCACT GCATGGG | 1446 | miR-207 | CATCAAAGTGGAGGCCCTCTCT | 1482 |
| miR-292 | CAGCCTGTGATACTC AAACTGGGGGCTCTT TTGGATTTTCATCGG AAGAAAAGTGCCGCC AGGTTTTGAGTGTCA CCGGTTG | 1447 | miR-291 | AAGTGCCGCCAGGTTTTGAGTGT | 1483 |
| miR-292 | CAGCCTGTGATACTC AAACTGGGGGCTCTT TTGGATTTTCATCGG AAGAAAAGTGCCGCC AGGTTTTGAGTGTCA CCGGTTG | 1447 | miR-292 | ACTCAAACTGGGGGCTCTTTTG | 1484 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| miR-293 | TTCAATCTGTGGTACTCAAACTGTGTGACATTTTGTTCTTTGTAAGAAGTGCCGCAGAGTTTGTAGTGTTGCCGATTGAG | 1448 | miR-292 | AGTGCCGCAGAGTTTGTAGTGT | 1485 |
| miR-294 | TTCCATATAGCCATACTCAAAATGGAGGCCCTATCTAAGCTTTTAAGTGGAAAGTGCTTCCCTTTTGTGTGTTGCCATGTGGAG | 1449 | miR-293 | AAAGTGCTTCCCTTTTGTGTGT | 1486 |
| miR-295 | GGTGAGACTCAAATGTGGGGCACACTTCTGGACTGTACATAGAAAGTGCTACTACTTTTGAGTCTCTCC | 1450 | miR-294 | AAAGTGGTACTACTTTTGAGTCT | 1487 |
| miR-300 | GCTACTTGAAGAGAGGTTATCCTTTGTGTGTTTGCTTTACGCGAAATGAATATGCAAGGGCAAGCTCTCTTCGAGGAGC | 1451 | miR-295 | TATGCAAGGGCAAGCTCTCTTC | 1488 |
| miR-322 | CCTCGTTGACTCCGAAGGGCTGCAGCAGCAATTCATGTTTTGGAGTATTGCCAAGGTTCAAAACATGAAGCGCTGCAACACCCCTTCGTGGGGAA | 1452 | miR-300 | AAACATGAAGCGCTGCAACA | 1489 |
| miR-344 | CTGCAGCCAGGGTTTTTACCAGTCAGGCTCCTGGCTAGATTCCAGGTACCAGCTGGTACCTGATCTAGCCAAAGCCTGACTGTAAGCCCTGAACA | 1453 | miR-322 | TGATCTAGCCAAAGCCTGACTGT | 1490 |
| miR-350 | AGATGCCTTGCTCCTACAAGAGTAAAGTGCATGCGCTTTGGGACAGTGAGGAAAATAATGTTCACAAAGCCCATACACTTTCACCCTTTAGGAGAGTTG | 1454 | miR-344 | TTCACAAAGCCCATACACTTTCAC | 1491 |
| miR-290 | CTCATCTTGCGGTACTCAAACTATGGGGCACTTTTTTTTTCTTTAAAAAGTGCCGCCTAGTTTTAAGCCCCGCCGGTTGAG | 1455 | miR-350 | CTCAAACTATGGGGCACTTTTT | 1492 |
| miR-351 | CATGGCACCTCCGTTTCCCTGAGGAGCCCTTTGAGCCTGGAGTGAAAAAAAAAAACAGGTCAAGAGGCGCCTGGGAACTGGAGAAGAGTGTTAAACTTC | 1456 | miR-290 | TCCCTGAGGAGCCCTTTGAGCCTG | 1493 |
| miR-341 | AAAATGATGATGTCAGTTGGCCGGTCGGCCGATCGCTCGGTCTGTCAGTCAGTCGGTCGGTCGATCGGTCGGTCG | 1457 | miR-351 | TCGATCGGTCGGTCGGTCAGT | 1494 |

TABLE 61-continued

Mouse pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTCAGTCGGCTTCCT GTCTTC | | | | |
| miR-298 | CCAGGCCTTTGGCAG AGGAGGGCTGTTCTT CCCTTGAGTTTTATG ACTGGGAGGAACTAG CCTTCTCTCAGCTTA GGAGTGG | 1458 | miR-341 | GGCAGAGGAGGGCTGTTCTTCC | 1495 |

A list of rat pri-miRNAs and the mature miRNAs predicted to derive from them is shown in Table 62. "Pri-miRNA name" indicates the gene name for each of the pri-miRNAs, and "pri-miRNA sequence" indicates the sequence of the predicted primary miRNA transcript. Also given in table 62 are the name and sequence of the mature miRNA derived from the pri-miRNA. Mature miRNA sequences from pri-miRNA precursors have been proposed by several groups; consequently, for a given pri-miRNA sequence, several miRNAs may be disclosed and given unique names, and thus a given pri-miRNA sequence may occur repeatedly in the table. The sequences are written in the 5' to 3' direction and are represented in the DNA form. It is understood that a person having ordinary skill in the art would be able to convert the sequence of the targets to their RNA form by simply replacing the thymidine (T) with uracil (U) in the sequence.

TABLE 62

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-20 | CAGCTTCTGTAG CACTAAAGTGCT TATAGTGCAGGT AGTGTGTCGTCA TCTACTGCATTA CGAGCACTTACA GTACTGCCAGCT G | 1496 | miR-20* (mouse) | ACTGCATTACGAGCACTTACA | 1608 |
| mir-20 | CAGCTTCTGTAG CACTAAAGTGCT TATAGTGCAGGT AGTGTGTCGTCA TCTACTGCATTA CGAGCACTTACA GTACTGCCAGCT G | 1496 | miR-20 (RFAM-Human) | TAAAGTGCTTATAGTGCAGGTA | 1126 |
| mir-20 | CAGCTTCTGTAG CACTAAAGTGCT TATAGTGCAGGT AGTGTGTCGTCA TCTACTGCATTA CGAGCACTTACA GTACTGCCAGCT G | 1496 | mir-20 | TAAAGTGCTTATAGTGCAGGTAG | 254 |
| mir-151* (Ruvkun) | AGCGCTTTCCTG CCCTCGAGGAGC TCACAGTCTAGT ATGTCTCCTCCC TACTAGACTGAG GCTCCTTGAGGA CAGGGATCGTCA TACTCACCTCCC G | 1497 | mir-151L (rodent) | ACTAGACTGAGGCTCCTTGAGG | 1476 |
| mir-151* (Ruvkun) | AGCGCTTTCCTG CCCTCGAGGAGC TCACAGTCTAGT | 1497 | mir-151 (rodent) | CTAGACTGAGGCTCCTTGAGG | 1477 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ATGTCTCCTCCC TACTAGACTGAG GCTCCTTGAGGA CAGGGATCGTCA TACTCACCTCCC G | | | | |
| mir-151* (Ruvknu) | AGCGCTTTCCTG CCCTCGAGGAGC TCACAGTCTAGT ATGTCTCCTCCC TACTAGACTGAG GCTCCTTGAGGA CAGGGATCGTCA TACTCACCTCCC G | 1497 | mir-151* (Ruvkun) | TCGAGGAGCTCACAGTCTAGTA | 1256 |
| mir-346 (Ruvkun) | TCTGTGTTGGGC ATCTGTCTGCCT GAGTGCCTGCCT CTCTGTTGCTCT GAAGGAGGCAGG GGCTGGGCCTGC AGCTGCCTGGGC AGAGCTGCTCCT TC | 1498 | miR-346 (rat) | TGTCTGCCTGAGTGCCTGCCTCT | 1609 |
| mir-143 | CCTGAGCGCGGA GCGCCTGTCTCC CAGCCTGAGGTG CAGTGCTGCATC TCTGGTCAGTTG GGAGTCTGAGAT GAAGCACTGTAG CTCAGGAAGGGA GAAGATGTTCTG CAGCC | 1499 | miR-143 (Michael et al) | TGAGATGAAGCACTGTAGCTC | 1088 |
| mir-143 | CCTGAGCGCGGA GCGCCTGTCTCC CAGCCTGAGGTG CAGTGCTGCATC TCTGGTCAGTTG GGAGTCTGAGAT GAAGCACTGTAG CTCAGGAAGGGA GAAGATGTTCTG CAGCC | 1499 | mir-143 | TGAGATGAAGCACTGTAGCTCA | 220 |
| mir-203 | GGTCCAGTGGTT CTTAACAGTTCA ACAGTTCTGTAG CGCAATTGTGAA ATGTTTAGGACC ACTAGACCCGGC GCGCACGGC | 1500 | mir-203 | GTGAAATGTTTAGGACCACTAG | 197 |
| mir-203 | GGTCCAGTGGTT CTTAACAGTTCA ACAGTTCTGTAG CGCAATTGTGAA ATGTTTAGGACC ACTAGACCCGGC GCGCACGGC | 1500 | miR-203 (RFAM- M. mu.) | TCAAATGTTTAGGACCACTAG | 1068 |
| mir-203 | GGTCCAGTGGTT CTTAACAGTTCA ACAGTTCTGTAG CGCAATTGTGAA ATGTTTAGGACC ACTAGACCCGGC GCGCACGGC | 1500 | miR-203 (Tuschl) | TGAAATGTTTAGGACCACTAGA | 1069 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-26b | GCCCGGGACCCAGTTCAAGTAATTCAGGATAGGTTGTGGTGCTGGCCAGCCTGTTCTCCATTACTTGGCTCGGGGGCCGGTGC | 1501 | miR-26b (RFAM-Human) | TTCAAGTAATTCAGGATAGGT | 1147 |
| mir-26b | GCCCGGGACCCAGTTCAAGTAATTCAGGATAGGTTGTGGTGCTGGCCAGCCTGTTCTCCATTACTTGGCTCGGGGGCCGGTGC | 1501 | mir-26b | TTCAAGTAATTCAGGATAGGTT | 281 |
| mir-128a | CCTGAGCTGTTGGATTCGGGGCCGTAGCACTGTCTGAGAGGTTTACATTTCTCACAGTGAACCGGTCTCTTTTTCAGCTGCTTG | 1276 | mir-128 (Kosik) | TCACAGTGAACCGGTCTCTTT | 1073 |
| mir-128a | CCTGAGCTGTTGGATTCGGGGCCGTAGCACTGTCTGAGAGGTTTACATTTCTCACAGTGAACCGGTCTCTTTTTCAGCTGCTTC | 1276 | mir-128a | TCACAGTGAACCGGTCTCTTTT | 200 |
| mir-29b_1 | CTCTTCTTCTGGAAGCTGGTTTCACATGGTGGCTTAGATTTTTCCATCTTTGTATCTAGCACCATTTGAAATCAGTGTTTTAGGAGTAAGAA | 1277 | miR-29b (RFAM-Human) | TAGCACCATTTGAAATCAGT | 1172 |
| mir-29b_1 | CTCTTCTTCTGGAAGCTGGTTTCACATGGTGGCTTAGATTTTTCCATCTTTGTATCTAGCACCATTTGAAATCAGTGTTTTAGGAGTAAGAA | 1277 | miR-29b (RFAM-M. mu.) | TAGCACCATTTGAAATCAGTGT | 1173 |
| mir-29b_1 | CTCTTCTTCTGGAAGCTGGTTTCACATGGTGGCTTAGATTTTTCCATCTTTGTATCTAGCACCATTTGAAATCAGTGTTTTAGGAGTAAGAA | 1502 | mir-29b | TAGCACCATTTGAAATCAGTGTT | 195 |
| mir-29c | GGCTGACCGATTTCTCCTGGTGTTCAGAGTCTGTTTTTGTCTAGCACCATTTGAAATCGGTTA | 1278 | mir-29c | CTAGCACCATTTGAAATCGGTT | 232 |
| mir-29c | GGCTGACCGATTTCTCCTGGTGTTCAGAGTCTGTTTTTGTCTAGCACCATTTGAAATCGGTTA | 1278 | miR-29c (Tuschl) | TAGCACCATTTGAAATCGGTTA | 1100 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
| --- | --- | --- | --- | --- | --- |
| mir-123/mir-126 | CGGTGACAGCAC ATTATTACTTTT GGTACGCGCTGT GACACTTCAAAC TCGTACCGTGAG TAATAATGCGTG GTCAACAGC | 1503 | mir-123/mir-126as | CATTATTACTTTTGGTACGCG | 205 |
| mir-123/mir-126 | CGGTGACAGCAC ATTATTACTTTT GGTACGCGCTGT GACACTTCAAAC TCGTACCGTGAG TAATAATGCGTG GTCAACAGC | 1503 | mir-126 | TCGTACCGTGAGTAATAATGC | 1076 |
| mir-130a | GGGTGAGGAGGC GGGCCGGCATGC CTTTGCTGCTGG CCGGAGCTCTTT TCACATTGTGCT ACTGTCTACACG TGTACCGAGCAG TGCAATGTTAAA AGGGCATCGGCC TTGTAGTACTAC CCAGTGCCGGCA GCCTCCTCAG | 1504 | mir-130a | CAGTGCAATGTTAAAAGGGC | 233 |
| mir-130a | GGGTGAGGAGGC GGGCCGGCATGC CTTTGCTGCTGG CCGGAGCTCTTT TCACATTGTGCT ACTGTCTACACG TGTACCGAGCAG TGCAATGTTAAA AGGGCATCGGCC TTGTAGTACTAC CCAGTGCCGGCA GCCTCCTCAG | 1504 | mir-130 (Kosik) | CAGTGCAATGTTAAAAGGGCAT | 1101 |
| mir-124a_3 | TGAGGGCCCCTC TGCGTGTTCACA GCGGACCTTGAT TTAATGTCTATA CAATTAAGGCAC GCGGTGAATGCC AAGAGAGGCGCC TC | 1282 | mir-124a (Kosik) | TAAGCCACGCGGTGAATGCCA | 1104 |
| mir-124a_3 | TGAGGGCCCCTC TGCGTGTTCACA GCGGACCTTGAT TTAATGTCTATA CAATTAAGGCAC GCGGTGAATGCC AAGAGAGGCGCC TC | 1282 | mir-124a | TTAAGGCACGCGGTGAATGCCA | 235 |
| mir-124a_3 | TGAGGGCCCCTC TGCGTGTTCACA GCGGACCTTGAT TTAATGTCTATA CAATTAAGGCAC GCGGTGAATGCC AAGAGAGGCGCC TC | 1282 | mir-124a_Ruvkun | TTAAGGCACGCGGTGAATGCCAA | 1105 |
| mir-15b | CCTTAAAGTACT GTAGCAGCACAT CATGGTTTACAT ACTACAGTCAAG | 1286 | miR-15b (Michael et al) | TAGCAGCACATCATGGTTTAC | 1115 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ATGCGAATCATT ATTTGCTGCTCT AGAAATTTAAGG A | | | | |
| mir-15b | CCTTAAAGTACT GTAGCAGCACAT CATGGTTTACAT ACTACAGTCAAG ATGCGAATCATT ATTTGCTGCTGT AGAAATTTAAGG A | 1286 | mir-15b | TAGCAGCACATCATGGTTTACA | 246 |
| mir-16_3 | TTGTTCCGCTCT AGCAGCACGTAA ATATTGGCGTAG TGAAATAAATAT TAAACACCAATA TTATTGTGCTGC TTTAGTGTGAC | 1505 | mir-16 | TAGCAGCACGTAAATATTGGCG | 196 |
| mir-16_3 | TTGTTCCGCTCT AGCAGCACGTAA ATATTGGCGTAG TGAAATAAATAT TAAACACCAATA TTATTGTGCTGC TTTAGTGTGAC | 1505 | mir-16_Ruvkun | TAGCAGCACGTAAATATTGGCGT | 1176 |
| mir-137 | GACTCTCTTCGG TGACGGGTATTC TTGGGTGGATAA TACGGATTACGT TGTTATTGCTTA AGAATACGCGTA GTCGAGGAGAGT | 1288 | mir-137 | TATTGCTTAAGAATACGCGTAG | 270 |
| mir-101_1 | CAGGCTGCCCTG GCTCAGTTATCA CAGTGCTGATGC TGTCCATTCTAA AGGTACAGTACT GTGATAACTGAA GGATGGCAGCC | 1289 | mir-101 | TACAGTACTGTGATAACTGA | 265 |
| mir-101_1 | CAGGCTGCCCTG GCTCAGTTATCA CAGTGCTGATGC TGTCCATTCTAA AGGTACAGTACT GTGATAACTGAA GGATGGCAGCC | 1289 | miR-101 (RFAM-Human) | TACAGTACTGTGATAACTGAAG | 1170 |
| mir-29a | AGGATGACTGAT TTCTTTTGGTGT TCAGAGTCAATA GAATTTTCTAGC ACCATCTGAAAT CGGTTATAATG | 1291 | mir-29a | CTAGCACCATCTGAAATCGGTT | 247 |
| mir-29a | AGGATGACTGAT TTCTTTTGGTGT TCAGAGTCAATA GAATTTTCTAGC ACCATCTGAAAT CGGTTATAATG | 1291 | mir-29a_Ruvkun | TAGCACCATCTGAAATCGGTTA | 1116 |
| mir-29b_2 | AAGCTGGTTTCA TATGGTGGTTTA GATTTAAATAGT GATTGTCTAGCA | 1292 | miR-29b (RFAM-Human) | TAGCACCATTTGAAATCAGT | 1172 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CCATTTGAAATC AGTGTT | | | | |
| mir-29b_2 | AAGCTGGTTTCA TATGGTGGTTTA GATTTAAATAGT GATTGTCTAGCA CCATTTGAAATC AGTGTT | 1292 | miR-29b (RFAM-M. mu.) | TAGCACCATTTGAAATCAGTGT | 1173 |
| mir-29b_2 | AAGCTGGTTTCA TATGGTGGTTTA GATTTAAATAGT GATTGTCTAGCA CCATTTGAAATC AGTGTT | 1292 | mir-29b | TAGCACCATTTGAAATCAGTGTT | 195 |
| mir-131_3/mir-9 | AATGGGAGGCCC GTTTCTCTCTTT GGTTATCTAGCT GTATGAGTGCCA CAGAGCCGTCAT AAAGCTAGATAA CCGAAAGTAGAA ATGACTCT | 1506 | mir-131 | TAAAGCTAGATAACCGAAAGT | 211 |
| mir-131_3/mir-9 | AATGGGAGGCCC GTTTCTCTCTTT GGTTATCTAGCT GTATGAGTGCCA CAGAGGCGTCAT AAAGCTAGATAA CCGAAAGTAGAA ATGACTCT | 1506 | mir-131_Ruvkun | TAAAGCTAGATAACCGAAAGTA | 1080 |
| mir-131_3/mir-9 | AATGGGAGGCCC GTTTCTCTCTTT GGTTATCTAGCT GTATGAGTGCCA CAGAGCCGTCAT AAAGCTAGATAA CCGAAAGTAGAA ATGACTCT | 1506 | miR-9 | TCTTTGGTTATCTAGCTGTATGA | 1081 |
| mir-23a | TCGGCCGGCTGG GGTTCCTGGGGA TGGGATTTGATG CCAGTCACAAAT CACATTGCCAGG GATTTCCAACTG ACCC | 1507 | mir-23a | ATCACATTGCCAGGGATTTCC | 289 |
| mir-140 | TCTGTGTCCTGC CAGTGGTTTTAC CCTATGGTAGGT TACATCATGCTG TTCTACCACAGG GTAGAACCACGG ACAGGATACTG | 1508 | mir-140 | AGTGGTTTTACCCTATGGTAG | 192 |
| mir-140 | TCTGTGTCCTGC CAGTGGTTTTAC CCTATGGTAGGT TACATCATGCTG TTCTACCACAGG GTAGAACCACGG ACAGGATACTG | 1508 | miR-140-as | TACCACAGGGTAGAACCACGGA | 1065 |
| mir-140 | TCTGTGTCCTGC CAGTGGTTTTAC CCTATGGTAGGT TACATCATGCTG TTCTACGACAGG | 1508 | mir-239* (Kosik) | TACCACAGGGTAGAACCACGGACA | 1066 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GTAGAACCACGG ACAGGATACTG | | | | |
| mir-125b_1 | GCTCCCCTCAGT CCCTGAGACCCT AACTTGTGATGT TTACCGTTTAAA TCCACGGGTTAG GCTCTTGGGAGC TGCGAGTCG | 1509 | mir-125b | TCCCTGAGACCCTAACTTGTGA | 258 |
| mir-26a_1 | GAAGGCCGTGGC CTTGTTCAAGTA ATCCAGGATAGG CTGTGCAGGTCC CAAGGGGCCTAT TCTTGGTTACTT GCACGGGGACGC GGGCCTGGAC | 1510 | miR-26a (Michael et al) | TTCAAGTAATCCAGGATAGGC | 1203 |
| mir-26a_1 | GAAGGCCGTGGC CTTGTTCAAGTA ATCCAGGATAGG CTGTGCAGGTCC CAAGGGGCCTAT TCTTGGTTACTT GCACGGGGACGC GGGCCTGGAC | 1510 | mir-26a | TTCAAGTAATCCAGGATAGGCT | 226 |
| let-7i | CACACCATGGCC CTGGCTGAGGTA GTAGTTTGTGCT GTTGGTCGGGTT GTGACATTGCCC GCTGTGGAGATA ACTGCGCAAGCT ACTGCCTTGCTA GTGCTGGTGAT | 1302 | let-7i | TGAGGTAGTAGTTTGTGCT | 209 |
| let-7i | CACACCATGGCC CTGGCTGAGGTA GTAGTTTGTGCT GTTGGTCGGGTT GTGACATTGCCC GCTGTGGAGATA ACTGCGCAAGCT ACTGCCTTGCTA GTGCTGGTGAT | 1302 | let-7i_Ruvkun | TGAGGTAGTAGTTTGTGCTGTT | 1078 |
| mir-21 | GCTGTACCACCT TGTCGGGTAGCT TATCAGACTGAT GTTGACTGTTGA ATCTCATGGCAA CAGCAGTCGATG GGCTGTCTGACA TTTTGGTATC | 1511 | mir-21 | TAGCTTATCAGACTGATGTTGA | 236 |
| mir-22 | GGCTGAGCCGCA GTAGTTCTTCAG TGGCAAGCTTTA TGTCCTGACCCA GCTAAAGCTCCC AGTTGAAGAACT CTTCCCCTCTGC C | 1512 | mir-22 | AAGCTGCCAGTTGAAGAACTGT | 215 |
| mir-142 | AGACAGTGCAGT CACCCATAAACT AGAAAGCACTAC TAACAGCACTGG AGGGTGTAGTGT TTCCTACTTTAT | 1513 | mir-142 | CATAAAGTAGAAAGCACTAC | 217 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GGATGACTGTAC TGTG | | | | |
| mir-142 | AGACAGTGCAGT CACCCATAAACT AGAAAGCACTAC TAACAGCACTGG ACCGTGTAGTGT TTCCTACTTTAT GGATGACTGTAC TGTG | 1513 | miR-142-as | TGTAGTGTTTCCTACTTTATCC | 1086 |
| mir-142 | AGACAGTGCAGT CACCCATAAAGT AGAAACCACTAC TAACAGCACTGG AGGCTGTACTGT TTCCTACTTTAT GGATGAGTGTAC TCTG | 1513 | miR-142as (Michael et al) | TGTAGTGTTTCCTACTTTATGGA | 1087 |
| mir-144 | CCTTCGCTGGCA TATCATCATATA CTGTAAGTTTGT GATGAGACACTA CAGTATAGATCA TGTACTACTCTG GGTA | 1514 | mir-144 | TACAGTATAGATGATGTACTAG | 237 |
| mir-152 | CCGCGCCCACGT TCTGTGATACAC TCCGACTCCCGC TCTGGAGCAGTC AGTGCATGACAC AACTTGGGCCCC GT | 1515 | mir-152 | TCAGTGCATCACAGAACTTGG | 282 |
| mir-153_2 | ACTTAGCGGTCG CCACTGTCATTT TTGTGATGTTGC ACCTAGTAATAT GAGCCCACTTGC ATACTCACAAAA GTCATCATTGGA AACTGTG | 1516 | mir-153 | TTGCATAGTCACAAAAGTGA | 201 |
| let-7a_1 | TCTTCACTCTGG GATCAGGTAGTA GGTTGTATAGTT TTAGGGTCACAC CCACCACTGGGA GATAACTATACA ATCTACTGTCTT TCCTAAGGTGAT GGA | 1517 | let-7a | TCAGGTAGTAGGTTGTATAGTT | 222 |
| let-7d | TGGGCTCCTAGG AAGAGGTAGTAG GTTGCATAGTTT TAGGGCAGAGAT TTTGCCCACAAG GAGTTAACTATA CGACCTGCTGCC TTTCTTAGGGCC TTAT | 1518 | let-7d | AGAGGTAGTAGGTTGCATAGT | 245 |
| let-7d | TGGGCTCCTAGG AAGAGGTAGTAG GTTGCATAGTTT TAGGGCAGAGAT TTTGCCCACAAG GAGTTAACTATA CGACCTGCTGCC | 1518 | let-7d_Ruvkun | AGAGGTAGTAGGTTGCATAGTT | 1113 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TTTCTTAGGGCC TTAT | | | | |
| let-7d | TGGGCTCCTAGG AAGAGGTAGTAG GTTGCATAGTTT TAGGGCAGAGAT TTTGCCCACAAG GAGTTAACTATA CGACCTGCTGCC TTTCTTAGGGCC TTAT | 1518 | let-7d* (RFAM-M. mu.) | CTATACGACCTGCTGCCTTTCT | 1114 |
| let-7f_1 | TTGCTCTATCAG AGTGAGGTAGTA GATTGTATAGTT GTGGGGTAGTGA TTTTACCCTGTT TAGGAGATAACT ATACAATCTATT GCCTTCCCTGAG GAGTAGAC | 1519 | let-7f (Michael et al) | TGAGGTAGTAGATTGTATAGT | 1098 |
| let-7f_1 | TTGCTCTATCAG AGTGAGGTAGTA GATTGTATAGTT GTGGGGTAGTGA TTTTACCCTGTT TAGGAGATAACT ATACAATCTATT GCCTTCCCTGAG GAGTAGAC | 1519 | let-7f | TGAGGTAGTAGATTGTATAGTT | 231 |
| miR-24-1 | GACCCGCCCTCC GGTGCCTACTGA GCTGATATCAGT TCTCATTTCACA CACTGGCTCAGT TCAGCAGGAACA GGAGTCGAG | 1313 | miR-189 (RFAM-Human) | GTGCCTACTGAGCTGATATCAGT | 1271 |
| miR-24-1 | GACCCGCCCTCC GGTGCCTACTGA GCTGATATCAGT TCTCATTTCACA CACTGGCTCAGT TCAGCAGGAACA GGAGTCGAG | 1313 | mir-24 | TGGCTCAGTTCAGCAGGAACAG | 264 |
| mir-124a_1 | AGGCCTCTCTCT CCGTGTTCACAG CGGACCTTGATT TAAATGTCCATA CAATTAAGGCAC GCGGTGAATGCC AAGAATGGGGC | 1318 | mir-124a (Kosik) | TAAGGCACGCGGTGAATGGCA | 1104 |
| mir-124a_1 | AGGCCTCTCTCT CCGTGTTCACAG CGGACCTTGATT TAAATGTCCATA CAATTAAGGCAC GCGGTGAATGCC AAGAATGGGGC | 1318 | mir-124a | TTAAGGCACGCGGTGAATGCCA | 235 |
| mir-124a_1 | AGCCCTCTCTCT CCGTGTTCACAG CGGACCTTGATT TAAATGTCCATA CAATTAAGGCAC GCGGTGAATGCC AAGAATGGGGC | 1318 | mir-124a_Ruvkun | TTAAGGCACGCGGTGAATGCCAA | 1105 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-18 | GCTTTTTGTTCTAAGGTGCATCTAGTGCAGATAGTGAAGTAGACTAGCATCTACTGCCCTAAGTGCTCCTTCTGGCATAAG | 1319 | mir-18 | TAAGGTGCATCTAGTGCAGATA | 262 |
| mir-18 | GCTTTTTGTTCTAAGGTGCATCTAGTGCAGATAGTGAAGTAGACTAGCATCTACTGCCCTAAGTGCTCCTTCTGGCATAAG | 1319 | mir-18_Ruvkun | TAAGGTGCATCTAGTGCAGATAG | 1177 |
| mir-30b | TAAGCCGAGTTTCAGTTCATGTAAACATCCTACACTCAGCTGTCATACATGAGTTGGCTGGGATGTGGATGTTTACGTCAGCTGTCTTGGAGTATCC | 1520 | mir-30b | TGTAAACATCCTACACTCAGC | 266 |
| mir-30b | TAAGCCGAGTTTCAGTTCATGTAAACATCCTACACTCAGCTGTCATACATGAGTTGGCTGGGATGTGGATGTTTACGTCAGCTGTCTTGGAGTATCC | 1520 | mir-30b_Ruvkun | TGTAAACATCCTACACTCAGCT | 1137 |
| mir-30d | TGCTGTCAGAAAGTCTGTGTCTGTAAACATCCCCGACTGGAAGCTGTAAGCCACAGCCAAGCTTTCAGTCAGATGTTTGCTGCTACTGGCTCTTCGCATGCAT | 1521 | mir-30d | TGTAAACATCCCCGACTGGAAG | 240 |
| mir-30d | TGCTGTCAGAAAGTCTGTGTCTGTAAACATCCCCGACTGGAAGCTGTAAGCCACAGCCAAGCTTTCAGTCAGATGTTTGCTGCTACTGGCTCTTCGCATGCAT | 1521 | mir-30d_Ruvkun | TGTAAACATCCCCGACTGGAAGCT | 1108 |
| let-7b | GACACCGCGGGGTGAGGTAGTAGGTTGTGTCGTTTCAGGGCAGTGATGTCGCCCCTCCGAAGATAACTATACAACCTACTGCCTTCCCTGAGGCGCCCAG | 1522 | let-7b | TGAGGTAGTAGGTTGTGTGGTT | 212 |
| let-7b | GACACCGCGGGGTGACGTAGTAGGTTGTGTGGTTTCAGGGCAGTGATGTCGCCCCTCCGAAGATAACTATACAACCTACTGCCT | 1522 | let-7b_Ruvkun | TGAGGTAGTAGGTTGTGTGGTTT | 1082 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TCCCTGAGGCGC CCAG | | | | |
| let-7e | GCCCCGCCCCCC GGGCTGAGGTAG GAGGTTCTATAG TTGAGGAAGACA CCCGAGGAGATC ACTATACGGCCT CCTAGCTTTCCC CAGGCTGCGCCC | 1328 | let-7e | TGAGGTAGGAGGTTGTATAGT | 249 |
| mir-133a_1 | GCAATGCTTTGC TAAAGCTGGTAA AATGGAACCAAA TCGCCTCTTCAA TGGATTTGGTCC CCTTCAACCAGC TGTAGCTATGCA TTGAT | 1330 | mir-133a | TTGGTCCCCTTCAACCACCTGT | 255 |
| mir-145 | TTGTCCTCACGG TCCAGTTTTCCC AGGAATCCCTTG GATGCTAAGATG GGGATTCCTGGA AATACTGTTCTT GAGGTCATG | 1332 | miR-145 (Michael et al) | GTCCAGTTTTCCCAGGAATCC | 1122 |
| mir-145 | TTGTCCTCACGG TCCAGTTTTCCC AGGAATCCCTTG GATGCTAAGATG GGGATTCCTGGA AATACTGTTCTT GAGGTCATG | 1332 | mir-145 | GTCCAGTTTTCCCAGGAATCCCTT | 252 |
| mir-122a | TCCTTAGCAGAG CTCTGGAGTGTG ACAATGGTGTTT GTGTCCAAAACA TCAAACGCCATC ATCACACTAAAC AGCTACTG | 1523 | miR-122a, b (Tuschl) | TGGAGTGTGACAATGGTGTTTG | 1084 |
| mir-122a | TCCTTAGCAGAG CTCTGGAGTGTG ACAATGGTGTTT GTGTCCAAAACA TCAAACCCCATC ATCACACTAAAC AGCTACTG | 1523 | mir-122a | TGGAGTGTGACAATGGTGTTTGT | 214 |
| let-7f_2 | CTGGTGCTCTGT GGGATGAGGTAG TAGATTGTATAG TTTTAGGGTCAT ACCCCATCTTGG AGATAACTATAC AGTCTACTGTCT TTCCCACGGTGG TACAC | 1335 | let-7f (Michael et al) | TGAGGTAGTAGATTGTATAGT | 1098 |
| let-7f_2 | CTGGTGCTCTGT GGGATGAGGTAG TAGATTGTATAG TTTTAGGGTCAT ACCCCATCTTGG AGATAACTATAC AGTCTACTGTCT TTCCCACGGTGG TACAC | 1335 | let-7f | TGAGGTAGTAGATTGTATAGTT | 231 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-127 | TTTGATCACTGTCTCCAGCCTGCTGAAGCTCAGAGGGCTCTGATTCAGAAAGATCATCGGATCCGTCTGAGCTTGGCTGGTCGGAAGTCTCATCATCT | 1337 | mir-127_Ruvkun | TCGGATCCGTCTGAGCTTGG | 1204 |
| mir-127 | TTTGATCACTGTCTGCAGCCTGCTGAAGCTCAGAGGGCTCTGATTCAGAAAGATCATCGGATCCGTCTGAGCTTGGCTGGTCGGAAGTCTCATCATCT | 1337 | miR-127 | TCGGATCCGTCTGAGCTTGGCT | 1205 |
| mir-136 | GAGCCCTCGGAGGACTCCATTTGTTTTGATGATGGATTCTTAAGCTCCATCATCGTCTCAAATGAGTCTTCAGAGGGTTC | 1338 | miR-136 | ACTCCATTTGTTTTGATGATGGA | 1206 |
| mir-154 | CGGTGCTTGAAGATAGGTTATCCGTGTTGCCTTCGCTTTATTCGTGACGAATCATACACGGTTGACCTATTTTTCAGTACCAA | 1339 | miR-154 | TAGGTTATCCGTGTTGCCTTCG | 1207 |
| mir-30c_2 | ACCATGTTGTAGTGTGTGTAAACATCCTACACTCTCAGCTGTGAGCTCAAGGTGGCTGGGAGAGGGTTGTTTACTCCTTCTCCCATGGAAA | 1341 | mir-30c | TGTAAACATCCTACACTCTCAGC | 280 |
| mir-30c_2 | ACCATGTTGTAGTCTGTGTAAACATCCTACACTCTCAGCTGTCAGCTCAAGGTGGCTGGGAGAGGGTTGTTTACTCCTTCTGCCATCGAAA | 1341 | mir-30c_Ruvkun | TGTAAACATCCTACACTCTCAGCT | 1129 |
| mir-99b | GTCCTCCCACCCACCCGTACAACCGACCTTGCGGGGCCTTCGCCGCACACAAGCTCGTGTCTGTGGGTCCCTGTCGGCGCC | 1342 | miR-99b | CACCCGTAGAACCGACCTTGCG | 1201 |
| MiR-125a | CCGGCCTCTCCGTCCCTGAGACCCTTTAACCTGTCAGGACGTCCACGGTCACAGGTCAGGTTCTTGGCAGCCTCCCGCCTGGCTCAGCCACAACTTACGGATTTCAGGTGACCCCTGGCAA | 1524 | miR-125a | TCCCTGAGACCCTTTAACCTCTG | 1202 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-221 | TGAATATCCACCTCTGGGGCATGAACCTGCCATACAATGTACATTTCTGTGTTTGTTAGGCAACACCTACATTGTCTGCTGGGTTTCAGGCTACCTGGAA | 1525 | mir-221 (RFAM-mmu) | ACCTACATTGTCTCCTGGGTTT | 1106 |
| mir-221 | TGAATATCCAGCTCTGGCGCATGAACCTGGCATACAATGTAGATTTCTGTCTTTGTTAGGCAACAGCTACATTGTCTGCTGCCTTTCAGGCTACCTGGAA | 1525 | mir-221 | AGCTACATTGTCTGCTCCGTTTC | 238 |
| mir-101_3 | ATCTGAGACTGAACTGTCCTTTTTCGGTTATCATGGTACCGATGCTGTAGATCTGAAAGGTACAGTACTGTGATAGCTGAAGAATGGTGGTGCCATC | 1526 | mir-101b (rodent) | TACAGTACTGTGATAGCTGAAG | 1460 |
| mir-17/mir-91 | GTCAGGATAATGTCAAAGTGCTTACAGTGCAGGTAGTGGTGTGTGCATCTACTGCAGTGAAGGCACTTGTGGCATTGTGCTGAC | 1527 | mir-17 (human, rat) | ACTGCAGTGAAGGCACTTGT | 1180 |
| mir-17/mir-91 | GTCAGGATAATGTCAAAGTGCTTACAGTGCAGGTAGTGGTGTGTGCATCTACTGCAGTGAAGGCACTTGTGGCATTGTGCTGAC | 1527 | mir-91_Ruvkun | CAAAGTGCTTACAGTGCAGGTAG | 1181 |
| mir-17/mir-91 | GTCAGGATAATGTCAAAGTGCTTACAGTGCAGGTAGTGGTGTGTGCATCTACTGCAGTGAAGGCACTTGTGGCATTGTGCTGAC | 1527 | mir-17as/mir-91 | CAAAGTGCTTACAGTGCAGGTAGT | 204 |
| hypothetical miRNA 105 | GTTCCTTTTTCCTATGCATATACTTCTTTGTGGATCTGGTCTAAAGAGGTATAGCGCATGGGAAAATGGAGC | 1528 | hypothetical miRNA-105 | TTCCTATGCATATACTTCTTT | 1132 |
| mir-211 | GCTTGGACCTGTGACCTCTGGGCTTCCCTTTGTCATCCTTTGCCTAGGCCTCTGAGTGGGGCAAGGACAGCAAAGGGGGGCTCAGTGGTCACCTCTACTGCAGA | 1529 | mir-211 (rodent) | TTCCCTTTGTCATCCTTTGCCT | 1465 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-217 | TTTTGATGTCGC AGATACTGCATC AGGAACTGACTG GATAAGACTCAG TCACCATCAGTT CCTAATGCATTG CCTTCAGCATCT AAACA | 1530 | mir-217 (rodent) | TACTGCATCAGGAACTGACTGGAT | 1466 |
| mir-7_3 | TGAGCCAATGCT ATGTGGAAGACT TGTGATTTTGTT GTTCTGATATGA TATGACAACAAG TCACAGCCAGCC TCATAGAGTGGA CTCCCATCACCT T | 1531 | mir-7b (rodent) | TGGAAGACTTGTGATTTTGTT | 1468 |
| mir-325 (Ruvkun) | ATATAGTGCTTG GTTCCTAGTAGG TGCTCAGTAAGT GTTTGTGACATA ATTCGTTTATTG AGCACCTCCTAT CAATCAAGCACT GTGCTAGGCTCT GG | 1357 | mir-325 (rodent) | CCTAGTAGGTGCTCAGTAAGTGT | 1469 |
| mir-326 (Ruvkun) | CTCATCTGTCTG TGGGGCTGGGGG CAGGGCCTTTGT GAAGGCGGGTTA TGCTCAGATCGC CTCTGGGCCCTT CCTCCAGTCCCG AGGCAGATTTA | 1532 | miR-326 (Ruvkun) | CCTCTGGGCCCTTCCTCCAG | 1263 |
| mir-326 (Ruvkun) | CTCATCTGTCTG TGGGGCTGGGGG CAGGGCCTTTGT GAAGGCGGGTTA TGCTCAGATCGC CTCTGGGCCCTT CCTCCAGTCCCG AGGCAGATTTA | 1532 | mir-326 (rodent) | CCTCTGGGCCCTTCCTCCAGT | 1470 |
| mir-330 (Ruvkun) | GACCCTTTGGCG ATCTCTGCCTCT CTGGGCCTGTGT CTTAGGCTCTTC AAGATCTAACGA GCAAAGCACAGG GCCTGCAGAGAG GTAGCGCTCTGC TC | 1533 | mir-330 (rodent) | GCAAAGCACAGGGCCTGCAGAGA | 1472 |
| mir-337 (Ruvkun) | CAGTGTAGTGAG AAGTTGGGGGGT GGGAACGGCGTC ATGCAGGAGTTG ATTGCACAGCCA TTCAGCTCCTAT ATGATGCCTTTC TTCACCCCCTTC A | 1361 | mir-337 (rodent) | TTCAGCTCCTATATGATGCCTTT | 1473 |
| mir-345 (Ruvkun) | ACCCAAGTCCAG GCCTGCTGACCC CTAGTCCAGTGC TTGTGGTGGCTA CTGGGCCCTGAA | 1362 | mir-345 (rodent) | TGCTGACCCCTAGTCCAGTGC | 1474 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | CTAGGGGTCTGG AGACCTGGGTTT GATCTCCACAGG | | | | |
| mir_34b (RFAM) | GTGCTCGGTTTG TAGGCAGTGTAA TTAGCTGATTGT AGTGCGGTGCTG ACAATCACTAAC TCCACTGCCATC AAAACAAGGCAC | 1365 | mir-34b (mouse) | TAGGCAGTGTAATTAGCTGATTG | 1478 |
| mir-34 | GGCCGGCTGTGA GTAATTCTTTGG CAGTGTCTTAGC TGGTTGTTGTGA GTATTAGCTAAG GAAGCAATCAGC AAGTATACTGCC CTAGAAGTGCTG CACGTTGTTAGG CC | 1534 | mir-34 | TGGCAGTGTCTTAGCTGGTTGT | 194 |
| mir-34 | GGCCGGCTGTGA GTAATTCTTTGG CAGTGTCTTAGC TGGTTGTTGTGA GTATTAGCTAAG GAAGCAATCAGC AAGTATACTGCC CTAGAAGTGCTG CACGTTGTTAGG CC | 1534 | miR-172 (RFAM-M. mu.) | TGGCAGTGTCTTAGCTGGTTGTT | 1067 |
| mir-7_1/mir-7_1* | TTGGATGTTGGC CTAGTTCTGTGT GGAAGACTAGTG ATTTTGTTGTTT TTAGATAACTAA GACGACAACAAA TCACAGTCTGCC ATATGGCACAGG CCA | 1535 | mir-7_1*_Ruvkun | CAACAAATCACAGTCTGCCATA | 1070 |
| mir-7_1/mir-7_1* | TTGGATGTTGGC CTAGTTCTGTGT GGAAGACTAGTG ATTTTGTTGTTT TTAGATAACTAA GACGACAACAAA TCACAGTCTGCC ATATGGCACAGG CCA | 1535 | mir-7 | TGGAAGACTAGTGATTTTGTT | 198 |
| mir-10b | GTTGTAACGTTG TCTATATATACC CTGTAGAACCGA ATTTGTGTGGTA CCCACATAGTCA CAGATTCGATTC TAGGGAATATA TGGTCGATGCAA AAACTTCA | 1536 | miR-10b (Tuschl) | CCCTGTAGAACCGAATTTGTGT | 1071 |
| mir-10b | GTTGTAACGTTG TCTATATATACC CTGTAGAACCGA ATTTGTGTGGTA CCCACATAGTCA CAGATTCGATTC TAGGGAATATA TGGTCGATGCAA AAACTTCA | 1536 | mir-10b | TACCCTGTAGAACCGAATTTGT | 199 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-10b | GTTGTAACGTTG TCTATATATACC CTGTAGAACCGA ATTTGTGTGGTA CCCACATAGTCA CAGATTCGATTC TAGGGAATATA TGGTCGATGCAA AAACTTCA | 1536 | miR-10b (Michael et al) | TACCCTGTAGAACCGAATTTGTG | 1072 |
| mir-132 | GCCCCGCCCCCG CGTCTCCAGGGC AACCGTGGCTTT CGATTGTTACTG TGGGAACCGGAG GTAACAGTCTAC AGCCATGGTCGC CCCGCAGCACGC CCACGC | 1370 | miR-132 (RFAM-Human) | TAACAGTCTACAGCCATGGTCG | 1077 |
| mir-132 | GCCCCGCCCCCG CGTCTCCAGGGC AACCGTGGCTTT CGATTGTTACTG TGGGAACCGGAG GTAACAGTCTAC AGCCATGGTCGC CCCGCAGCACGC CCACGC | 1370 | mir-132 | TAACAGTCTACAGCCATGGTCGC | 206 |
| mir-212 | CCCCGCCCGGGC AGCGCGCCGGCA CCTTGGCTCTAG ACTGCTTACTGC CCGGGCCGCCCT CAGTAACAGTCT CCAGTCACGGCC ACCGACGCCTGG CCCCGCC | 1537 | mir-212 | TAACAGTCTCCAGTCACGGCC | 210 |
| mir-108_1 | CCGATGCACACT GCAAGAACAATA AGGATTTTTAGG GGCATTATGACT GAGTCAGGAAAC ACAGCTGCCCCT GAAAGTCCCTCA TTTTTCTTGCTG TCCT | 1538 | mir-108 | ATAAGGATTTTTAGGGGCATT | 207 |
| hypothetical miRNA 023 | AGATTTAATTAG CTCAGAGAAGAA ATGTTGCTTGGG CAAGAGGACTTT TTAATTATCAGC TTGGATAAATTT GAAAATGTTGAT GCCTAGGGGTTG AGTTAATTAAAA CC | 26 | hypothetical miRNA-023 | TGGGCAAGAGGACTTTTTAAT | 1079 |
| mir-214 | CCTGGATGGACA GAGTTGTCATGT GTCTGCCTGTCT ACACTTGCTGTG CAGAACATCCGC TCACCTGTACAG CAGGCACAGACA GGCAGTCACATG ACAACCCAGCCT | 1539 | mir-214 | ACAGCAGGCACAGACAGGCAG | 219 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| hypothetical miRNA 040 | GCCAGCAAATAATGGCTGTTGTATTAGCTGCTTTTGATGATAGTATGAAAGAAGTATTAGCACTTGTCAACAAAACTGCTTACAACATAACATTAGCATGCATGGGCTGC | 43 | hypothetical miRNA-040 | TGTCAACAAAACTGCTTACAA | 1092 |
| hypothetical miRNA 043 | CCCCTTATAGGCTCGTTTTGACAGGAAATCTTTGAGAGGCAGCGGCAGTGAGGTGCCCAGAGAGTTCATCTCTCTCTTTTGCTTTAGGAAATGCTGAGTACAAGGCTCC | 1540 | hypothetical miRNA-043 | TGACAGGAAATCTTTGAGAGG | 1094 |
| mir-205 | CAGACAATCCATGGGTCCTCCTGTCCTTCATTCCACCGGAGTCTGTCTTATGCCAACCAGATTTCAGTGGAGTGAAGCTCAGGAGGCATGGAGCTG | 1541 | mir-205 | TCCTTCATTCCACCGGAGTCTG | 224 |
| mir-33a | CCTCCTGGCGGGCTGCCGTGGTGCATTGTAGTTGCATTGCATGTTCTGGCAGTACCTGTGCAATGTTTCCACAGTGCATCACGGAGGCCTGCC | 1542 | mir-33a | GTGCATTGTAGTTGCATTG | 227 |
| mir-196_2 | TTGCTCAGCTGATCTGTGGCTTAGGTAGTTTCATGTTGTTGGGATTGAGTTTTGAACTCGGCAACAAGAAACTGCCTGAGTTACATCAGTCGGTTTTCGTCGAGGGC | 1543 | miR-196 (Tuschl) | TAGGTAGTTTCATGTTGTTGG | 1097 |
| mir-196_2 | TTGCTCAGCTGATCTGTGGCTTAGGTAGTTTCATGTTGTTGGGATTGAGTTTTGAACTCGGCAACAAGAAACTGCCTGAGTTACATCAGTCGGTTTTCGTCGAGGGC | 1543 | mir-196 | TAGGTAGTTTCATGTTGTTGGG | 228 |
| mir-218_1 | GTGATAACGTAGCGAGATTTTCTGTTGTGCTTGATCTAACCATGTGCTTGCGAGGTATGAGTAAAACATGGTTCCGTCAAGCACCATGGAACGTCACGCAGCTTTCTACA | 1544 | mir-218 | TTGTGCTTGATCTAACCATGT | 234 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-218_1 | GTGATAACGTAGCGAGATTTTCTGTTGTGCTTGATCTAACCATGTGCTTGCGAGGTATGAGTAAAACATGGTTCCGTCAAGCACCATGGAACGTCACGCAGCTTTCTACA | 1544 | mir-253* (Kosik) | TTGTCCTTGATCTAACCATGTG | 1103 |
| mir-222 | CCCTCAGTGGCTCAGTAGCCAGTGTAGATCCTGTCTTTGGTAATCAGCAGCTACATCTGGCTACTGGGTCTCTGATGGCATCATCTAGCT | 1545 | mir-222 (RFAM-mmu) | AGCTACATCTGGCTACTGGGTCT | 1107 |
| mir-222 | CCCTCAGTGGCTCAGTAGCCAGTGTAGATCCTGTCTTTGGTAATCAGCAGCTACATCTGGCTACTGGGTCTCTGATGGCATCATCTAGCT | 1545 | mir-222 | AGCTACATCTGGCTACTGGGTCTC | 239 |
| mir-128b | CCCGGCAGCCACTGTGCAGTGGGAAGGGGGGCCGATGCACTGTAAGAGAGTGAGTAGCAGGTCTCACAGTGAACCGGTCTCTTTCCCTACTGTGTCAAACTCCTAA | 1381 | mir-128 (Kosik) | TCACAGTGAACCGGTCTCTTT | 1073 |
| mir-128b | CCCGGCAGCCACTGTGCAGTGGGAAGGGGGGCCGATGCACTGTAAGAGAGTGAGTAGCAGGTCTCACAGTGAACCGGTCTCTTTCCCTACTGTGTCAAACTCCTAA | 1381 | mir-128b | TCACAGTGAACCGGTCTCTTTC | 242 |
| mir-219_2 | GCCCTGAACTCAGGGGCTTCACCACTGATTGTCCAAACGCAATTCTTGTACGAGTCTGCGGCCAACCGAGAATTGTGGCTGGACATCTGTGGTTGAGCTCCGG | 1546 | mir-219 | TGATTGTCCAAACGCAATTCT | 271 |
| hypothetical miRNA 070 | GATGCTTCATGTTGTCAGACTGAAGAATCTCTACAAGTAAGTGTGTGATTTCTTCAGTGACATCACATTTGCCTGCAGAGATTTCCCAGTCTGCCA | 1547 | hypothetical miRNA-070 | TCACATTTGCCTGCAGAGATT | 1109 |
| mir-129_2 | CTGCCCTTCGCGAATCTTTTTGCGGTCTGGGCTTGCTGTACATAACTC | 1548 | mir-129as/mir-258* (Kosik) | AAGCCCTTACCCCAAAAAGCAT | 1110 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | AATAGCCCGAAG CCCTTACCCCAA AAAGCATTCGCG GAGGGCGCGCTC G | | | | |
| mir-129_2 | CTGCCCTTCGCG AATCTTTTGCG GTCTGGGCTTGC TGTACATAACTC AATAGCCGGAAG CCCTTACCCCAA AAAGCATTCGCG GAGGGCGCGCTC G | 1548 | mir-129 | CTTTTTGCGCTCTGGGCTTGC | 243 |
| mir-129_2 | CTGCCCTTCGCG AATCTTTTGCG GTCTGGGCTTGC TGTACATAACTC AATAGCCGGAAG CCCTTACCCCAA AAAGCATTCGCG GAGGGCGCGCTC G | 1548 | miR-129b (RFAM-Human) | CTTTTTGCGGTCTGGGCTTGCT | 1111 |
| mir-133b | GCCCCCTGCTCT GGCTGGTCAAAC GGAACCAAGTCC GTCTTCCTGAGA GGTTTGGTCCCC TTCAACCAGCTA CAGCAGGGCTGG CAA | 1385 | mir-133b | TTGGTCCCCTTCAACCAGCTA | 244 |
| hypothetical miRNA 075 | AGCGCAGCTTTA ATTACTCATGCT GCTGGTTAAAAT ATTAATGGGGCA CAGAGTGTTGCA TGCTCATTTCTG TTGATTTTTAAT TAGCAGTAATTC ATTTTGCACAAA GC | 78 | hypothetical miRNA-075 | TGGTTAAAATATTAATGGGGC | 1112 |
| mir-204 | GGCTACAGCCCT TCTTCATGTGAC TCGTGGACTTCC GTTTGTCATCCT ATGCCTGAGAAT ATATGAAGGAGG CTGGGAAGGCAA AGGGACGTTCAA TTGTCATCACTG GC | 1549 | mir-204 | TTCCCTTTGTCATCCTATGCCT | 251 |
| mir-204 | GGCTACAGCCCT TCTTCATGTGAC TCGTGGACTTCC CTTTGTCATCCT ATGCCTGAGAAT ATATGAAGGAGG CTGGGAAGGCAA AGGGACGTTCAA TTGTCATCACTG GC | 1549 | miR-204 (Tuschl) | TTCCCTTTGTCATCCTATGCCTG | 1121 |
| mir-213/ mir-181a_2 | AGGTTGCTTCAG TGAACATTCAAC GCTGTCGGTGAG TTTGGAATTCAA ATAAAAACCATC | 1550 | mir-178 (Kosik) | AACATTCAACGCTGTCGGTGAG | 1096 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | GACCGTTGATTG TACCCTATAGCT AACCATTATCTA CTCC | | | | |
| mir-213/ mir-181a_2 | AGGTTGCTTCAG TGAACATTCAAC GCTGTCGGTGAG TTTGGAATTCAA ATAAAAACGATC GACCGTTGATTG TACCCTATAGCT AACCATTATCTA CTCC | 1550 | mir-181a | AACATTCAACGCTGTCGGTGAGT | 223 |
| mir-213/ mir-181a_2 | AGGTTGGTTCAG TGAACATTCAAC GCTGTCGGTGAG TTTGGAATTCAA ATAAAAACCATC GACCGTTGATTG TACCCTATAGCT AACCATTATCTA CTCC | 1550 | mir-213 | ACCATCGACCGTTGATTGTACC | 253 |
| hypothetical miRNA 090 | CAGCGATACATT AATGCTCATCTG GCTCTGCAAATC TCACCGTTTGCT TAGGCCAAATGG CGCATCAATGAC TATCGCTCTTAC AAAACTCTTGAA TCAGTATTATGT AA | 1551 | hypothetical miRNA-090 | TAGGCCAAATGGCGCATCAAT | 1124 |
| mir-138_2 | GGTATGGTTGCT GCAGCTGGTGTT GTGAATCAGGCC GACGAGCAACGC ATCCTCTTACCC GGCTATTTCACG ACACCAGGGTTG CACCCTACCCAT CCTC | 1552 | mir-138 | AGCTGGTGTTGTGAATC | 256 |
| mir-138_2 | GGTATGGTTGCT GCAGCTGGTGTT GTGAATCAGGCC GACGAGCAACGC ATCCTCTTACCC GGCTATTTCACG ACACCAGGGTTG CACCCTACCCAT CCTC | 1552 | mir-138_Ruvkun | AGCTGGTGTTGTGAATCAGGCCG | 1127 |
| mir-199a_2 | GGAAGCTTCTGG AGATCCTGCTCC GTCGCCCCAGTG TTCAGACTACCT GTTCAGGACAAT GCCGTTGTACAG TAGTCTGCACAT TGGTTAGACTGG GCAAGGG | 1553 | miR-199-s | CCCAGTGTTCAGACTACCTGTT | 1128 |
| mir-199a_2 | GGAAGCTTCTGG AGATCCTGCTCC GTCGCCCCAGTG TTCAGACTACCT GTTCAGGACAAT GCCGTTGTACAG TAGTCTGCACAT | 1553 | mir-199a | CCCAGTGTTCAGACTACCTGTTC | 259 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TGGTTAGACTGG GCAAGGG | | | | |
| mir-199a_2 | GGAAGCTTCTGG AGATCCTGCTCC GTCGCCCCAGTG TTCAGACTACCT GTTCAGGACAAT GCCGTTGTACAG TAGTCTGCACAT TGGTTAGACTGG GCAAGGG | 1553 | miR-199-as | TACAGTAGTCTGCACATTGGTT | 1118 |
| hypothetical miRNA 101 | GTATATTCAAGG ACAGGCCATTGA CAGTCAATTAAC AAGTTTGATTGG TATGTCAACTCA TTCTTTTGAATT GTTAATAGTATG TTAATAGCGTTC GTTTCTTTGTGC AG | 1554 | hypothetical miRNA-101 | TGACAGTCAATTAAGAAGTTT | 1130 |
| mir-148b | TTAGCATTTGAG GTGAAGTTCTGT TATACACTCAGG CTGTGGCTCTGA AAGTCAGTGCAT CACAGAACTTTG TCTCGAAAGCTT TCTAGCAGC | 1397 | mir-148b | TCAGTGCATCACAGAACTTTGT | 272 |
| mir-216 | GCTATGAGTTAG TTTAATCTCAGC TGGCAACTGTGA GATGTCCCTATC ATTCCTCACAGT GGTCTCTGGGAT TATGCTAAACAG AGCAATTTCCT | 1555 | mir-216 | TAATCTCAGCTGGCAACTGTG | 274 |
| hypothetical miRNA 137 | GTTCAACATAAG CAAACAGATTGT AAACTGGCTGAT AATTTTGTACT GACAATGTCATT TACAGCTGTCAG CCTTTCGTCTGT CTTGTTTGCTTT ATTCAAATATGA AC | 1399 | hypothetical miRNA-137 | TAAACTGGCTGATAATTTTTG | 1141 |
| hypothetical miRNA 138 | CCCTCCAATGTC TGATTAATCAAG CCTGCAAACAGC TTATTTCTTTTT GCCTGCATGCAA GTATGAAAATGA GATTCTGGGAGC CGAACACTGTGC AGATTTGTTCAT TC | 1556 | hypothetical miRNA-138 | TGCAAGTATGAAAATGAGATT | 1142 |
| mir-210 | GGCAGTCCCTCC AGGCTCAGGACA GCCACTGCCCAC AGCACACTGCGT TGCTCCGGACCC ACTGTGCGTGTG ACAGCGGCTGAT CTGTCCCTGGGC AGCGCGA | 1557 | mir-210 | CTGTGCGTGTGACAGCGGCTG | 277 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-223 | CTGCAGTGTTACGCTCCGTGTATTTGACAAGCTGAGTTGGACACTCTGTGTGGTAGAGTGTCAGTTTGTCAAATACCCCAAGTGTGGCTCATGC | 1558 | mir-223 | TGTCAGTTTGTCAAATACCCC | 279 |
| hypothetical miRNA 154 | CCTGCAGTGATGCTTCATGAGCAAATCACATGATGTCAGAATGGTATGGTTTCGATTTAATCAAGAAAGAGATTAAAGTGGATGTGTGTTATTTTCAACTTCGCCGCAGC | 1404 | hypothetical miRNA-154 | TTAAAGTGGATGTGTGTTATT | 1146 |
| non-coding RNA in rhabdo-myosarcoma/mir-135_2 | CCAAGATAAATTCACTCTAGTGCTTTATGGCTTTTTATTCCTATGTGATCGTAATAAAGTCTCATGTAGGGATGGAAGCCATGAAATACATTGTGAAAATTCATCAACT | 13 | miR-135 (RFAM-Human) | TATGGCTTTTTATTCCTATGTGA | 1149 |
| non-coding RNA in rhabdo-myosarcoma/mir-135_2 | CCAAGATAAATTCACTCTAGTGCTTTATGGCTTTTTATTCCTATGTGATCGTAATAAAGTCTCATGTAGGGATGGAAGCCATGAAATACATTGTGAAAATTCATCAACT | 13 | mir-135 | TATGGCTTTTTATTCCTATGTGAT | 283 |
| hypothetical miRNA 170 | GAATGTATGATCTTGCTCTAACACTTGCCCAGACCTGTGTCACCCACTGCTAGTGCCTGAAGTCGACAGACAATTCTGCCAAGGTAACTGAGAATCATTAAGCATCCTCC | 1559 | hypothetical miRNA-170 | TGATCTTGCTCTAACACTTGG | 1157 |
| glutamate receptor, ionotropic, AMPA 2/hypothetical miRNA-171 | CACCCTGTCTGACAACTATGTTTTATCGTTTCAAGAAATGCGGTTAACCTCGCAGTACTAAAACTGAATGAACAAGGCCTGTTGGACAAATTGAAAACAAATGGTGGTA | 174 | hypothetical miRNA-171 | TGACAAGTATGTTTTATCGTT | 1158 |
| hypothetical miRNA 176 | TGGAAGGAAATAGGAGTTTGATATGACATATTGTGTGTCTCAGCAAGACTCATAAATAATTTTGACAAGTTTTTGTATCCATGGGAAAGTCCTTG | 179 | hypothetical miRNA-176 | TAGGAGTTTGATATGACATAT | 1163 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | ATTCAGCCTCCC AT | | | | |
| hypothetical miRNA 179 | AATGCCAGCGAG TTTGAAAGGCAC TTTGTCCAATTA GAAGTGTGGGA GCTATCCATCCT GTCCATGACCAA GATGAAGCACTT CTTTCAAAAG | 1560 | hypothetical miRNA-179 | TGAAAGGCACTTTGTCCAATT | 1166 |
| hypothetical miRNA 181 | TGTGCACCTCAC CTGCTCTGGAAG TAGTTTGCTAGC TCTGATGCTTCA TGGTTCAGACTC CTCAGGTGCACG ATTAAATTTCCA GAGTTGGTGAAC ATGGCGCCACAT G | 1409 | hypothetical miRNA-181 | TCACCTGCTCTGCAAGTAGTT | 1167 |
| mir-181c | TTGCCAAGGGTT TGGGGGAACATT CAACCTGTCGGT GAGTTTGGGCAG CTCAGACAAACC ATCGACCGTTGA GTGGACCCCGAG GCCTGGAACTGC CA | 1410 | mir-181c | AACATTCAACCTGTCGGTGAGT | 290 |
| mir-100_1 | CCTGTTGCCACA AACCCGTAGATC CGAACTTGTGCT GACCATGCACAC AAGCTTGTGTCT ATAGGTATGTGT CTGTTAGG | 1561 | mir-100 | AACCCGTAGATCCGAACTTGTG | 275 |
| mir-103_1 | TACTGCCCTCGG CTTCTTTACAGT GCTGCCTTGTTG CATATGGATCAA GCAGCATTGTAC AGGGCTATGAAG GCATTG | 950 | mir-103 | AGCAGCATTGTACAGGGCTATGA | 225 |
| mir-107 | CTCTCTGCTTTA AGCTTCTTTACA GTGTTGCCTTGT GGCATGGAGTTC AAGCAGCATTGT ACAGGGCTATCA AAGCACAGA | 1562 | mir-107 | AGCAGCATTGTACAGGGCTATCA | 229 |
| mir-19a | CCTCTGTTCGTT TTGCATAGTTGC ACTACAACAAGA ATGTAGTTGTGC AAATCTATGCAA AACTGATGGTGG CCTG | 1563 | mir-19a | TGTGCAAATCTATGCAAAACTGA | 268 |
| mir-19b_1 | TCTATGGTTAGT TTTGCAGGTTTG CATCCAGCTGTA TAATATTCTGCT GTGCAAATCCAT GCAAAACTGACT GTGGT | 1414 | mir-19b* (Michael et al) | AGTTTTGCAGGTTTGCATCCAGC | 1179 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-19b_1 | TCTATGGTTAGT TTTGCAGGTTTG CATCCAGCTGTA TAATATTCTGCT GTGCAAATCCAT GCAAAACTGACT GTGGT | 1414 | mir-19b | TGTGCAAATCCATGCAAAACTGA | 241 |
| mir-92_1 | CTTTCTACACAG GTTGGGATTTGT CGCAATGCTGTG TTTCTGTATAGT ATTGCACTTGTC CCGGCCTGTTGA GTTTGG | 1564 | miR-92 (RFAM-M. mu.) | TATTGCACTTGTCCCGGCCTG | 1182 |
| mir-92_1 | CTTTCTACACAG GTTGGGATTTGT CGCAATGCTGTG TTTCTGTATAGT ATTGCACTTGTC CCGGCCTGTTGA GTTTGG | 1564 | mir-92 | TATTGCACTTGTCCCGGCCTGT | 216 |
| mir-98 | GTGAGGTAGTAA GTTGTATTGTTG TGGGGTAGGGAT TTTAGGCCCCAA TAAGAAGATAAC TATACAACTTAC TACTTTCC | 1565 | mir-98 | TGAGGTAGTAAGTTGTATTGTT | 257 |
| mir-104 (Mourelatos) | AAATGTCAGACA GCCCATCGACTG CTGTTGCCATGA GATTCAACAGTC AACATCAGTCTG ATAAGCTACCCG ACAAGG | 1566 | miR-104 (Mourelatos) | TCAACATCAGTCTGATAAGCTA | 335 |
| mir-27 (Mourelatos) | CCTGTGGAGCAG GGCTTAGCTGCT TGTGAGCAAGGT CTACAGCAAAGT CGTGTTCACAGT GGCTAAGTTCCG CCCCC | 1567 | miR-27 (Mourelatos) | TTCACAGTGGCTAAGTTCC | 1186 |
| mir-27 (Mourelatos) | CCTGTGGAGCAG GGCTTAGCTGCT TGTGAGCAAGGT CTACAGCAAAGT CGTGTTCACAGT GGCTAAGTTCCG CCCCC | 1567 | miR-27a (RFAM-M. mu.) | TTCACAGTGGCTAAGTTCCGC | 1187 |
| mir-27 (Mourelatos) | CCTGTGGAGCAG GGCTTAGCTGCT TGTGAGCAAGGT CTACAGCAAAGT CGTGTTCACAGT GGCTAAGTTCCG CCCCC | 1567 | miR-27a (RFAM-Human) | TTCACAGTGGCTAAGTTCCGCC | 1188 |
| mir-31 | CTCCTGAAACTT GGAACTGGAGAG GAGGCAAGATGC TGGCATAGCTGT TGAACTGAGAAC CTGCTATGCCAA CATATTGCCATC TTTCCTGTCTGA CAGCAGC | 1568 | miR-31 (RFAM-M. mu.) | AGGCAAGATGCTGGCATAGCTG | 1197 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
| --- | --- | --- | --- | --- | --- |
| mir-31 | CTCCTGAAACTT GGAACTGGAGAG GAGGCAAGATGC TGGCATAGCTGT TGAACTGAGAAC CTGCTATGCCAA CATATTGCCATC TTTCCTGTCTGA CAGCAGC | 1568 | miR-31 (Tuschl) | GGCAAGATGCTGGCATAGCTG | 1198 |
| mir-32 | GCTTGCTCTGGT GGGGATATTGCA CATTACTAAGTT GCATGTTGTCAC GGCCTCAATGCA ATTTAGTGTGTG TGATATTCTCAC ATGAGTGCATGC A | 1569 | miR-32 (Tuschl) | TATTGCACATTACTAAGTTGC | 1199 |
| mir_186 | ATTGCTTACAAC TTTCCAAAGAAT TCTCCTTTTGGG CTTTCTCATTTT ATTTTAAGCCCA AAGGTGAATTTT TTGGGAAGTTTG AGCT | 1570 | miR-186 | CAAAGAATTCTCCTTTTGGGCTT | 1208 |
| mir_191 | CCAATGGCTGGA CAGCGGGCAACG GAATCCCAAAAG CAGCTGTTGTCT CCAGAGCATTCC AGCTGCACTTGG ATTTCGTTCCCT GCTCTCCTGCCT GAGC | 1571 | mir-191 | CAACGGAATCCCAAAAGCAGCT | 1210 |
| mir_191 | CCAATGGCTGGA CAGCGGGCAACG GAATCCCAAAAG CAGCTGTTGTCT CCAGAGCATTCC AGCTGCACTTGG ATTTCGTTCCCT GCTCTCCTGCCT GAGC | 1422 | mir-191_Ruvkun | CAACGGAATCCCAAAAGCAGCTGT | 1211 |
| mir_195 | CCTGGCTCTAGC AGCACAGAAATA TTGGCACGGGTA AGTGAGTCTGCC AATATTGGCTGT GCTGCTCCAGGC AGGGTGGTG | 1572 | miR-195 | TAGCAGCACAGAAATATTGGC | 1216 |
| mir_193 | GGGAGCTGAGAG CTGGGTCTTTGC GGGCAAGATGAG GGTGTCAGTTCA ACTGGCCTACAA AGTCCCAGTCCT CGG | 1573 | miR-193 | AACTGGCCTACAAAGTCCCAG | 1217 |
| mir_208 | TTCCTTTGACGG GTGAGCTTTTGG CCCGGGTTATAC CTGACTCTCACG TATAAGACGAGC AAAAAGCTTGTT GGTCAGAGGAG | 1574 | miR-208 | ATAAGACGAGCAAAAAGCTTGT | 1222 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir_139 | GGACAGGCGCAGGTGTATTCTACAGTGCACGTGTCTCCAGTGTGGCTCGGAGGCTGGAGACGCGGCCCTGTTGGAGTAACAACTGAAGCCAGAGTCT | 1427 | miR-139 | TCTACAGTGCACGTGTCT | 1223 |
| mir-200b | GTGGCCATCTTACTGGGCAGCATTGGATAGTGTCTGATCTCTAATACTGCCTGGTAATGATGACGGCGGAG | 1428 | miR-200a (RFAM-Human) | CTCTAATACTGCCTGGTAATGATG | 1224 |
| mir-200b | GTGGCCATCTTACTGGGCAGCATTGGATAGTGTCTGATCTCTAATACTGCCTGGTAATGATGACGGCGGAG | 1428 | miR-200b (Michael et al) | TAATACTGCCTGGTAATGATGA | 1225 |
| mir-200b | GTGGCCATCTTACTGGGCAGCATTGGATAGTGTCTGATCTCTAATACTGCCTGGTAATGATGACGGCGGAG | 1428 | miR-200b | TAATACTGCCTGGTAATGATGAC | 1226 |
| mir-200a | GGGCCTCTGTGGGCATCTTACCGGACAGTGCTGGATTTCTTGGCTTGACTCTAACACTGTCTGGTAACGATGTTCAAAGGTGACCC | 1429 | miR-200a | TAACACTGTCTGGTAACGATG | 1227 |
| mir-200a | GGGCCTCTGTGGGCATCTTACCGGACAGTGCTGGATTTCTTGGCTTGACTCTAACACTGTCTGGTAACGATGTTCAAAGGTGACCC | 1429 | miR-200a (RFAM-M. mu.) | TAACACTGTCTGGTAACGATGT | 1228 |
| mir-227* (Kosik)/mir-226* (Kosik) | TGACTATGCCTCCTCGCATCCCCTAGGGCATTGGTGTAAAGCTGGAGACCCACTGCCCCAGGTGCTGCTGGGGGTTGTAGTCT | 1430 | mir-226* (Kosik) | ACTGCGCGAGGTGCTGCTGG | 1231 |
| mir-227* (Kosik)/mir-226* (Kosik) | TGACTATGCCTCCTCGCATCCCCTAGGGCATTGGTGTAAAGCTGGAGACCCACTGCCCCAGGTGCTGCTGGGGGTTGTAGTCT | 1430 | mir-324-3p_Ruvkun | CCACTGCCCCAGGTGCTGCTGG | 1232 |
| mir-227* (Kosik)/mir-226* (Kosik) | TGACTATGCCTCCTCGCATCCCCTAGGGCATTGGTGTAAAGCTGGAGACCCACTGCCCCAGGTGCTGCTGCGGGTTGTAGTCT | 1430 | mir-227* (Kosik) | CGCATCCCCTAGGGCATTGGTGT | 1233 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-244* (Kosik) | GTCCTCCCCAACAATATCCTGGTGCTGAGTGGGTGCACAGTGACTCCAGCATCAGTGATTTTGTTGAAGAGGGCAGCTGCCA | 1431 | mir-244* (Kosik) | TCCAGCATCAGTGATTTTGTTGA | 1234 |
| mir-224* (Kosik) | TGGTACTTGGAGAGAGGTGGTCCGTGGCGCGTTCGCTTCATTTATGGCGCACATTACACGGTCGACCTCTTTGCGGTATCTA | 1432 | mir-224* (Kosik) | GCACATTACACGGTCGACCTCT | 1235 |
| mir-248* (Kosik) | GAAAATGGGCTCAAGGTGAGGGGTGCTATCTGTGATTGAGGGACATGGTCAATGGAATTGTCTCACACAGAAATCGCACCCGTCACCTTGGCCT | 1433 | mir-248* (Kosik) | TCTCACACAGAAATCGCACCCGTC | 1236 |
| mir-138_3 | ATGGTGTTGTGGGACAGCTGGTGTTGTGAATCAGGCCGTTGCCAATCAGAGAACGGCTACTTCACAACACCAGGG | 1575 | mir-138 | AGCTGGTGTTGTGAATC | 256 |
| mir-138_3 | ATGGTGTTGTGGGACAGCTGGTGTTGTGAATCAGGCCGTTGCCAATCAGAGAACGGCTACTTCACAACACCAGGG | 1575 | mir-138_Ruvkun | AGCTGGTGTTGTGAATCAGGCCG | 1127 |
| mir-181b_2 | ATGGCTGCACTCAACATTCATTGCTGTCGGTGGGTTTGAATGTCAACCAACTCACTGGTCAATGAATGCAAACTGCGGGCCAAA | 1576 | mir-181b | AACATTCATTGCTGTCGGTGGGTT | 260 |
| mir-134 (Sanger) | CAGGGTGTGTGACTGGTTGACCAGAGGGGCGTGCACTTTGTTCACCCTGTGGGCCACCTAGTCACCAACCCTC | 1289 | miR-134 (RFAM-Human) | TGTGACTGGTTGAGCAGAGGG | 1240 |
| mir-146 (Sanger) | TGTGTATCCTCAGCTCTGAGAACTGAATTCCATGGGTTATAGCAATGTCAGACCTGTGAAGTTCAGTTCTTTAGCTGGGATAGCTCT | 1577 | miR-146 (RFAM-Human) | TGAGAACTGAATTCCATGGGTT | 1241 |
| mir-30e (RFAM/mmu) | GGGCAGTCTTTGCTACTGTAAACATCCTTGACTGGAAGCTGTAAGGTGTTGAGAGGAGCTTTCAGTCGGATG | 1578 | miR-30e (RFAM-M. mu.) | TGTAAACATCCTTGACTGGA | 1243 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TTTACAGCGGCA GGCTGCCAC | | | | |
| mir-30e (RFAM/mmu) | GGGCAGTCTTTG CTACTGTAAACA TCCTTGACTGGA AGCTGTAAGGTG TTGAGAGGAGCT TTCAGTCGGATG TTTACAGCGGCA GGCTGCCAC | 1578 | miR-97 (Michael et al) | TGTAAACATCCTTGACTGGAAG | 1244 |
| mir-299 (RFAM/mmu) | CGGTACTTGAAG AAATGGTTTACC GTCCCACATACA TTTTGAGTATGT ATGTGGGACGGT AAACCGCTTCTT GGTATCC | 1440 | miR-299 (RFAM-M. mu.) | TGGTTTACCGTCCCACATACAT | 1246 |
| mir-34a (RFAM/mmu) | TGAGTCTAGTTA CTAGGCAGTGTA GTTAGCTGATTG CTAATAGTACCA ATCACTAACCAC ACAGCCAGGTAA AAAGA | 1579 | mir-34c (RFAM) | AGGCAGTGTAGTTAGCTGATTG | 1250 |
| mir-34a (RFAM/mmu) | TGAGTCTAGTTA CTAGGCAGTGTA GTTAGCTGATTG CTAATAGTACCA ATCACTAACCAC ACAGCCAGGTAA AAAGA | 1579 | mir-34a (RFAM-M. mu.) | AGGCAGTGTAGTTAGCTGATTGC | 1251 |
| mir-135b (Ruvkun) | TGCTGTGGCCTA TGGCTTTTCATT CCTATGTGATTG CTGTTCCGAACT CATGTAGGGCTA AAAGCCATGGGC TACAGTG | 1580 | mir-135b (Ruvkun) | TATGGCTTTTCATTCCTATGTG | 1254 |
| mir-331 (Ruvkun) | TGTTTGGGTTTG TTCTAGGTATGG TCCCAGGGATCC CAGATCAAACCA GGCCCCTGGGCC TATCCTAGAACC AACCTAA | 1442 | mir-331 (Ruvkun) | GCCCCTGGGCCTATCCTAGAA | 1258 |
| mir-187 | CCTCAGGCTACA ACACAGGACCCG GGCGCTGCTCTG ACCCCTCGTGTC TTGTGTTGCAGC CGGAGGGACGCA GGTC | 1443 | miR-187 (RFAM-Human) | TCGTGTCTTGTGTTGCAGCCG | 1270 |
| mir-187 | CCTCAGGCTACA ACACAGGAGCCG GGCGCTGCTCTG ACCCCTCGTGTC TTGTGTTGCAGC CGGAGGGACGCA GGTC | 1443 | mir-187 | TCGTGTCTTGTGTTGCAGCCGG | 276 |
| collagen, type I, alpha 1/ hypothetical miRNA-144 | CACGCATGAGCC GAAGCTAACCCC CCACCCCAGCCG CAAAGAGTCTAC ATGTCTAGGGTC | 1581 | hypothetical miRNA-144 | AGACATGTTCAGCTTTGTGGA | 1063 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | TAGACATGTTCA GCTTTGTGGACC TCCGGCTCCTGC TCCTCTTAGGGG CCA | | | | |
| DiGeorge syndrome critical region gene 8/ hypothetical miRNA-088 | TTAAGCTGAGTG CATTGTGATTTC CAATAATTGAGG CAGTGGTTCTAA AAGCTGTCTACA TTAATGAAAAGA GCAATGTGGCCA GCTTGACTAA | 1582 | hypothetical miRNA-088 | TGTGATTTCCAATAATTGAGG | 1123 |
| hypothetical miR-13/miR-190 | CTGGATGCCTTT TCTGCAGGCCTC TGTGTGATATGT TTGATATATTAG GTTGTTATTTAA TCCAACTATATA TCAAGCATATTC CTACAGTGTCTT GCCCTGTCTCCG GG | 1583 | miR-190 | TGATATGTTTGATATATTAGGT | 1075 |
| hypothetical miRNA 039 | CTTGGGTGGGCA GCTGTTAAGACT TGCAGTGATGTT TAGCTCCTCTCC ATGTGAACATCA CAGCAAGTCTGT GCTGCTGCCTGC CCCCATGCTGCC TGGG | 1584 | hypothetical miRNA-039 | TAAGACTTGCAGTGATGTTTA | 1091 |
| hypothetical miRNA 041 | CATACACGGCTG TTACACAGGTTT TCCCATGATAAG GCGATAGGTTAA TGAAATGCTCAT TTCATTTTACCA GTTGTTTTCTCT GTGAAGTTCCGA TAAGTAGCAAAC CA | 1585 | hypothetical miRNA-041 | TACCAGTTGTTTTCTCTGTGA | 1093 |
| hypothetical miRNA 044 | GCCTGAAATGAA ATTACCATATTT TTAATCTTAATT TTCCACTCTGTT TATCTGACAGTG TGGATGTGCAAT CCAAACAGATAA TGAGAGAGTGGG ATATTGACACCG CT | 47 | hypothetical miRNA-044 | TTCCACTCTGTTTATCTGACA | 1095 |
| hypothetical miRNA 083 | TGGCAGGTTGTT TAGTTTTTTCGT TTGAAGGTTTTC ATTAGTCTAATG AGGACTGTGCAA GGGCGAGCAGTC AGCACAATTTAC ATGGGGAAGCTA TCATAATAAATG AA | 86 | hypothetical miRNA-083 | TTACATGGCGAAGCTATCATA | 1119 |
| hypothetical miRNA 107 | CTATAATGCTTA GATTATCAATCA TCTTGACAGTTT ATTGGCTTTATC | 1586 | hypothetical miRNA-107 | TGACAGTTATTGGCTTTATC | 1133 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
| --- | --- | --- | --- | --- | --- |
| | ACCACACATACC ATTAAAATGATG TCTGGCCCAGAC TGTCAAAAGCAA ACATTAAACAGA CC | | | | |
| mir-10a | CTGTCTGTCTTC TGTATATACCCT GTAGATCCGAAT TTGTGTAAGGAA TTTTGTGGTCAC AAATTCGTATCT AGGGGAATATGT AGTTGACATAAA CACTCCGCTC | 1587 | mir-10a (Tuschl) | TACCCTGTAGATCCGAATTTGT | 1139 |
| mir-10a | CTGTCTGTCTTC TGTATATACCCT GTAGATCCGAAT TTGTGTAAGGAA TTTTGTGGTCAC AAATTCGTATCT AGGGGAATATGT AGTTGACATAAA CACTCCGCTC | 1587 | mir-10a | TACCCTGTAGATCCGAATTTGTG | 267 |
| mir-130b | GACACTCTTTCC CTGTTGCACTAC TGTGGGCCTCTG GGAAGCAGTGCA ATGATGAAAGGG CATCCGTCAGG | 1588 | mir-130b | CAGTGCAATGATGAAACGGC | 273 |
| mir-130b | GACACTCTTTCC CTGTTGCACTAC TGTGGGCCTCTG GGAAGCAGTGCA ATGATGAAAGGG CATCCGTCAGG | 1588 | mir-266* (Kosik) | CAGTGCAATGATGAAAGGGCAT | 1140 |
| hypothetical miRNA-177_1 | GGGAACCAGTGC TTTCAGTAAGAG GGTGGTACCACA TGTCTTCAAAAT GAAACGTCTCTT GGAGACAAACAT GCTACTCTCACT G | 1589 | hypothetical miRNA-177 | AGACAAACATGCTACTCTCAC | 1164 |
| mir_185 | GGGGGTGAGGGA TTGGAGAGAAAG GCAGTTCCTGAT GGTCCCCTCCCA GGGGCTGGCTTT CCTCTGGTCCTT CTCTCCCA | 1590 | miR-185 | TGGAGAGAAAGGCAGTTC | 1218 |
| mir_194_2 | TCCCACCCCCTG TAACAGCAACTC CATGTGGAAGTG CCCACTGATTCC AGTGGGGCTGCT GTTATCTGGGG | 1591 | miR-194 | TGTAACAGCAACTCCATGTGGA | 1221 |
| mir-150 (Sanger) | GGCCCTGTCTCC CAACCCTTGTAC CAGTGCTGTGCC TCAGACCCTGGT ACAGGCCTGGGG GACAGGGACTTG GGGAC | 1592 | miR-150 (RFAM-Human) | TCTCCCAACCCTTGTACCAGTG | 1242 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-301 (RFAM/mmu) | TACTGCTGACGA CTGCTCTGACTT TATTGCACTACT GTACTGTACAGC TAGCAGTGCAAT AGTATTGTCAAA GCATC | 1593 | miR-301 (RFAM-M. mu.) | CAGTGCAATAGTATTGTCAAAGC | 1247 |
| mir-301 (RFAM/mmu) | TACTGCTGACGA CTGCTCTGACTT TATTGCACTACT GTACTGTACAGC TAGCAGTGCAAT AGTATTGTCAAA GCATC | 1593 | mir-301_Ruvkun | CAGTGCAATAGTATTGTCAAAGCAT | 1248 |
| mir_320 | CCTCCGCCTTCT CTTCCCGGTTCT TCCCGGAGTCGG GAAAAGCTGGGT TGAGAGGGCGAA AAAGGAT | 1594 | miR-320 | AAAAGCTGGGTTGAGAGGGCGAA | 1252 |
| mir_200c (RFAM) | GGGGCCCTCGTC TTACCCAGCAGT GTTTGGGTGCTG GTTGGGAGTCTC TAATACTGCCGG GTAATGATGGAG GCCCCTG | 1595 | mir-200c (RFAM) | AATACTGCCGGGTAATGATGGA | 1259 |
| miR-322 | CCTCGCTGACTC CGAAGGCATGCA GCAGCAATTCAT GTTTTGGAGTAT TGCCAAGGTTCA AAACATGAAGCG CTGCAACACCCC TTCGTGGGAAA | 1596 | miR-322 | AAACATGAAGCGCTGCAACA | 1489 |
| miR-341 | AAAATGATGATG TCAGTTGGCCGG TCGGCCGATCGC TCGGTCTGTCAG TCAGTCGGTCGG TCGATCGGTCGG TCGGTCAGTCGG CTTCCTGTCTTC | 1457 | miR-341 | TCGATCGGTCGGTCGGTCAGT | 1494 |
| miR-344 | CTGCAGCCAGAG TTTTTACCAGTC AGGCTCCTGGCT AGATTCCAGGTA CCAACTGGTACC TGATCTAGCCAA AGCCTGACCGTA AGCTGCAAAAGA AA | 1597 | miR-344 | TGATCTAGCCAAAGCCTGACCGT | 1610 |
| miR-350 | AGATGCCTTGCT CCTACAAGAGTA AAGTGCACGTGC TTTGGGACAGTG AGGAAAATAATG TTCACAAAGCCC ATACACTTTCAC CCTTTAGGAGAG TTG | 1598 | miR-350 | TTCACAAAGCCCATACACTTTCAC | 1491 |
| miR-351 | CATGGCACCTCC ATTTCCCTGAGG AGCCCTTTGAGC CTGAGGTGAAAA | 1599 | miR-351 | TCCCTGAGGAGCCCTTTGAGCTG | 1493 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| | AAAAACAGGTCA AGAGGCGCCTGG GAACTGGAG | | | | |
| miR-290 | TCATCTTGCGGT TCTCAAACTATG GGGGCACTTTTT TTTTCTTTAAAA AGTGCCGCCAGG TTTTAGGGCCTG CCGGTTGAG | 1600 | miR-290 | CTCAAACTATGGGGGCACTTTTT | 1492 |
| miR-291 | CCGGTGTAGTAG CCATCAAAGTGG AGGCCCTCTCTT GGGCCCGAGCTA GAAAGTGCTTCC ACTTTGTGTGCC ACTGCATGGG | 1601 | miR-291 | AAAGTGCTTCCACTTTGTGTGCC | 1481 |
| miR-291 | CCGGTGTAGTAG CCATCAAAGTGG AGGCCCTCTCTT GGGCCCGAGCTA GAAAGTGCTTCC ACTTTGTGTGCC ACTGCATGGG | 1601 | miR-291 | CATCAAAGTGGAGGCCCTCTCT | 1482 |
| miR-292 | CAACCTGTGATA CTCAAACTGGGG GCTCTTTTGCGT TTTCTTTGGAAG AAAAGTGCCGCC AGGTTTTGAGTG TTACCGATTG | 1602 | miR-292 | AAGTGCCGCCAGGTTTTGAGTGT | 1483 |
| miR-292 | CAACCTGTGATA CTCAAACTGGGG GCTCTTTTGGGT TTTCTTTGGAAG AAAAGTGCCGCC AGGTTTTGAGTG TTACCGATTG | 1602 | miR-292 | ACTCAAACTGGGGGCTCTTTTG | 1484 |
| miR-298 | CCAGGCCTTCGG CAGAGGAGGGCT GTTCTTCCCTTG GGTTTTATGACT GGGAGGAACTAG CCTTCTCTCTGC TTAGGAGTGG | 1603 | miR-298 | GGCACAGGAGGGCTGTTCTTCC | 1495 |
| miR-300 | GCTACTTGAAGA GAGGTTATCCTT TGTGTGTTTGCT TTACGCGAAATG AATATGCAAGGG CAAGCTCTCTTC GAGGAGC | 1604 | miR-300 | TATGCAAGGGCAAGCTCTCTTC | 1488 |
| miR-333 | CCCCGGTGGAAC CACGTGGTGTGC TAGTTACTTTTG GGCTGGAGAGAC GGCTCAGGGGTT AAGAGCACAGAC TGCTCTTCCAGA GGTCCTGAGTT | 1605 | miR-333 | GTGGTGTGCTAGTTACTTTT | 1611 |
| miR-336 | ATGTGACCGTGC CTCTCACCCTTC CATATCTAGTCT CTGAGAAAATG | 1606 | miR-336 | TCACCCTTCCATATCTAGTCT | 1612 |

TABLE 62-continued

Rat pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| miR-349 | AAGACTGGATTC CATGAAGGGATG TGAGGCCTGGAA ACTGGAGCTTTA GAAGACTCTAGC ATGTAAGGTTGG GGGAGGGGGCTG TGTCTAGCAAGT CTTCTTCCCCCA CAGCCCTGCTGT CTTAACCTCTAG CTGTTCCGGCTC C | 1607 | miR-349 | CAGCCCTGCTGTCTTAACCTCT | 1613 |

A list of *Drosophila* pri-miRNAs and the mature miRNAs predicted to derive from them is shown in Table 63. "Pri-miRNA name" indicates the gene name for each of the pri-miRNAs, and "pri-miRNA sequence" indicates the sequence of the predicted primary miRNA transcript. Also given in table 63 are the name and sequence of the mature miRNA derived from the pri-miRNA. The sequences are written in the 5' to 3' direction and are represented in the DNA form. It is understood that a person having ordinary skill in the art would be able to convert the sequence of the targets to their RNA form by simply replacing the thymidine (T) with uracil (U) in the sequence.

Table 64 describes a series of oligomeric compounds designed and synthesized to target different regions of pri-miRNAs. These oligomeric compounds can be analyzed for their effect on miRNA, pre-miRNA or pri-miRNA levels by quantitative real-time PCR, or they can be used in other assays to investigate the role of miRNAs or miRNA downstream targets. In Table 64, "Pri-miRNA" indicates the particular pri-miRNA which contains the miRNA that the oligomeric compound was designed to target. All compounds listed in Table 64 have phosphorothioate internucleoside linkages. In some embodiments, chimeric oligonucleotides

TABLE 63

Drosophila pri-miRNA sequences and the corresponding mature miRNAs

| Pri-miRNA name | Pri-miRNA sequence | SEQ ID NO | Mature miRNA name | Mature miRNA sequence | SEQ ID NO |
|---|---|---|---|---|---|
| mir-14 | GGAGCGAGACGGGGACTCACT GTGCTTATTAAATAGTCAGTC TTTTTCTCTCTCCTATACAAA TTGCGGGC | 1614 | miR-14 | TCAGTCTTTTTCTCTCTCCTA | 1616 |
| mir-bantam | AATGATTTGACTACGAAACCG GTTTTCGATTTGGTTTGACTG TTTTTCATACAAGTGAGATCA TTTTGAAAGCTGATTTTGTCA ATGAATA | 1615 | mir-Bantam | GTGAGATCATTTTGAAAGCTG | 1617 |

Oligomeric compounds targeting or mimicking pri-miR-NAs, pre-miRNAs, or miRNAs were given internal numerical identifiers (ISIS Numbers) and are shown in Tables 64, 65, and 66 respectively. The sequences are written in the 5' to 3' direction and are represented in the DNA form. It is understood that a person having ordinary skill in the art would be able to convert the sequence of the targets to their RNA form by simply replacing the thymidine (T) with uracil (U) in the sequence.

("gapmers") are composed of a central "gap" region consisting of ten 2'-deoxynucleotides, which is flanked on both sides (5' and 3' directions) by five nucleotide "wings," wherein the wings are composed of 2'-methoxyethoxy (2'-MOE) nucleotides. These chimeric compounds are indicated in the "Chemistry" column as "5-10-5 MOE gapmer." In some embodiments, oligomeric compound consist of 2'-MOE ribonucleotides throughout, are indicated by "uniform MOE."

TABLE 64

Phosphorothioate oligomeric compounds targeting pri-miRNAs

| ISIS # | SEQ ID NO | sequence | chemistry | Pri-miRNA |
|---|---|---|---|---|
| 338615 | 442 | AGAACAGCATGACGTAACCT | uniform MOE | mir-140, Human |
| 338616 | 443 | GCCCATCTGTGGCTTCACAG | uniform MOE | mir-30a, Human |
| 338617 | 444 | GAAGTGCGAGGCAGTAGGCA | uniform MOE | mir-30a, Human |
| 338618 | 445 | CTTCCTTACTATTGCTCACA | uniform MOE | mir-34, Human |
| 338619 | 446 | GCTAGATACAAAGATGGAAA | uniform MOE | mir-29b-1, Human |
| 338620 | 447 | CTAGACAATCACTATTTAAA | uniform MOE | mir-29b-2, Human |
| 338621 | 448 | GCAGCGCAGCTGGTCTCCCC | uniform MOE | mir-29b-2, Human |
| 338622 | 449 | TAATATATATTTCACTACGC | uniform MOE | mir-16-3, Human |
| 338623 | 450 | TGCTGTATCCCTGTCACACT | uniform MOE | mir-16-3, Human |
| 338624 | 451 | CAATTGCGCTACAGAACTGT | uniform MOE | mir-203, Human |
| 338625 | 452 | TCGATTTAGTTATCTAAAAA | uniform MOE | mir-7-1, Human |
| 338626 | 453 | CTGTAGAGGCATGGCCTGTG | uniform MOE | mir-7-1, Human |
| 338627 | 454 | TGACTATACGGATACCACAC | uniform MOE | mir-10b, Human |
| 338628 | 455 | GGAACAAGGCCAATTATTGC | uniform MOE | mir-128a, Human |
| 338629 | 456 | AGAAATGTAAACCTCTCAGA | uniform MOE | mir-128a, Human |
| 338630 | 457 | AGCTGTGAGGGAGAGAGAGA | uniform MOE | mir-153-1, Human |
| 338631 | 458 | CTGGAGTGAGAATACTAGCT | uniform MOE | mir-153-1, Human |
| 338632 | 459 | ACTGGGCTCATATTACTAGC | uniform MOE | mir-153-2, Human |
| 338633 | 460 | TTGGATTAAATAACAACCTA | uniform MOE | hypothetical miR-13/miR-190, Human |
| 338634 | 461 | CCCGGAGACAGGGCAAGACA | uniform MOE | hypothetical miR-13/miR-190, Human |
| 338635 | 462 | AAAGCGGAAACCAATCACTG | uniform MOE | chromosome 9 ORF3 containing mir-23b, mir-24-2 and mir-27b, Human |
| 338636 | 463 | GTCCCCATCTCACCTTCTCT | uniform MOE | chromosome 9 ORF3 containing mir-23b, mir-24-2 and mir-27b, Human |
| 338637 | 464 | TCAGAGCGGAGAGACACAAG | uniform MOE | mir-96, Human |
| 338638 | 465 | TAGATGCACATATCACTACC | uniform MOE | miR-17/mir-91, Human |
| 338639 | 466 | CTTGGCTTCCCGAGGCAGCT | uniform MOE | miR-17/mir-91, Human |
| 338640 | 467 | AGTTTGAAGTGTCACAGCGC | uniform MOE | mir-123/mir-126, Human |
| 338641 | 468 | GCGTTTTCGATGCGGTGCCG | uniform MOE | mir-123/mir-126, Human |
| 338642 | 469 | GAGACGCGGGGCGGGGCGC | uniform MOE | mir-132, Human |
| 338643 | 470 | TACCTCCAGTTCCCACAGTA | uniform MOE | mir-132, Human |
| 338644 | 471 | TGTGTTTTCTGACTCAGTCA | uniform MOE | mir-108-1, Human |
| 338645 | 472 | AGAGCACCTGAGAGCAGCGC | uniform MOE | chromosome 9 ORF3 containing mir-23b, mir-24-2 and mir-27b, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338646 | 473 | TCTTAAGTCACAAATCAGCA | uniform MOE | chromosome 9 ORF3 containing mir-23b, mir-24-2 and mir-27b, Human |
| 338647 | 474 | TCTCCACAGCGGGCAATGTC | uniform MOE | let-7i, Human |
| 338648 | 475 | GGCGCGCTGTCCGGGCGGGG | uniform MOE | mir-212, Human |
| 338649 | 476 | ACTGAGGGCGGCCCGGGCAG | uniform MOE | mir-212, Human |
| 338650 | 477 | GTCCTCTTGCCCAAGCAACA | uniform MOE | hypothetical miRNA-023, Human |
| 338651 | 478 | GAAGACCAATACACTCATAC | uniform MOE | mir-131-2/miR-9, Human |
| 338652 | 479 | CCGAGGGGCAACATCACTGC | uniform MOE | let-7b, Human |
| 338653 | 480 | TCCATAGCTTAGCAGGTCCA | uniform MOE | mir-1d-1, Human |
| 338654 | 481 | TTTGATAGTTTAGACACAAA | uniform MOE | mir-122a, Human |
| 338655 | 482 | GGGAAGGATTGCCTAGCAGT | uniform MOE | mir-122a, Human |
| 338656 | 483 | AGCTTTAGCTGGGTCAGGAC | uniform MOE | mir-22, Human |
| 338657 | 484 | TACCATACAGAAACACAGCA | uniform MOE | mir-92-1, Human |
| 338658 | 485 | TCACAATCCCCACCAAACTC | uniform MOE | mir-92-1, Human |
| 338659 | 486 | TCACTCCTAAAGGTTCAAGT | uniform MOE | hypothetical miRNA-30, Human |
| 338660 | 487 | CACCCTCCAGTGCTGTTAGT | uniform MOE | mir-142, Human |
| 338661 | 488 | CTGACTGAGACTGTTCACAG | uniform MOE | mir-183, Human |
| 338662 | 489 | CCTTTAGGGGTTGCCACACC | uniform MOE | glutamate receptor, ionotrophic, AMPA 3/ hypothetical miRNA-033, Human |
| 338663 | 490 | ACAGGTGAGCGGATGTTCTG | uniform MOE | mir-214, Human |
| 338665 | 492 | AGAGGGGAGACGAGAGCACT | uniform MOE | mir-192-1, Human |
| 338666 | 493 | TCACGTGGAGAGGAGTTAAA | uniform MOE | hypothetical miRNA-039, Human |
| 338667 | 494 | AGTGCTAATACTTCTTTCAT | uniform MOE | hypothetical miRNA-040, Human |
| 338668 | 495 | ACCTGTGTAACAGCCGTGTA | uniform MOE | hypothetical miRNA-041, Human |
| 338669 | 496 | TTATCGGAACTTCACAGAGA | uniform MOE | hypothetical miRNA-041, Human |
| 338670 | 497 | TCCCATAGCAGGGCAGAGCC | uniform MOE | let-7a-3, Human |
| 338671 | 498 | GGCACTTCATTGCTGCTGCC | uniform MOE | hypothetical miRNA-043, Human |
| 338672 | 499 | GGAGCGTTGCGCTCAGCATT | uniform MOE | hypothetical miRNA-043, Human |
| 338673 | 500 | ATGGTAATTTCATTTCAGGC | uniform MOE | hypothetical miRNA-044, Human |
| 338674 | 501 | GATTGCACATGCACACTGTC | uniform MOE | hypothetical miRNA-044, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338675 | 502 | GCTGGCCTGATAGCCCTTCT | uniform MOE | mir-181a, Human |
| 338676 | 503 | GTTTTTTCAAATCCCAAACT | uniform MOE | mir-181a, Human |
| 338677 | 504 | CCCAGTGGTGGGTGTGACCC | uniform MOE | let-7a-1, Human |
| 338678 | 505 | CTGGTTGGGTATGAGACAGA | uniform MOE | mir-205, Human |
| 338679 | 506 | TTGATCCATATGGAACAAGG | uniform MOE | mir-103-1, Human |
| 338680 | 507 | GCCATTGGGACCTGCACAGC | uniform MOE | miR-26a-1, Human |
| 338681 | 508 | ATGGGTACCACCAGAACATG | uniform MOE | mir-33a, Human |
| 338682 | 509 | AGTTCAAAACTCAATCCCAA | uniform MOE | mir-196-2, Human |
| 338683 | 510 | GCCCTCGACGAAAACCGACT | uniform MOE | mir-196-2, Human |
| 338684 | 511 | TTGAACTCCATGCCACAAGG | uniform MOE | mir-107, Human |
| 338685 | 512 | AGGCCTATTCCTGTAGCAAA | uniform MOE | mir-106, Human |
| 338686 | 513 | GTAGATCTCAAAAAGCTACC | uniform MOE | mir-106, Human |
| 338687 | 514 | CTGAACAGGGTAAAATCACT | uniform MOE | let-7f-1, Human |
| 338688 | 515 | AGCAAGTCTACTCCTCAGGG | uniform MOE | let-7f-1, Human |
| 338689 | 516 | AATGGAGCCAAGGTGCTGCC | uniform MOE | hypothetical miRNA-055, Human |
| 338690 | 517 | TAGACAAAAACAGACTCTGA | uniform MOE | mir-29c, Human |
| 338691 | 518 | GCTAGTGACAGGTGCAGACA | uniform MOE | mir-130a, Human |
| 338692 | 519 | GGGCCTATCCAAAGTGACAG | uniform MOE | hypothetical miRNA-058, Human |
| 338693 | 520 | TACCTCTGCAGTATTCTACA | uniform MOE | hypothetical miRNA-058, Human |
| 338694 | 521 | TTTACTCATACCTCGCAACC | uniform MOE | mir-218-1, Human |
| 338695 | 522 | AATTGTATGACATTAAATCA | uniform MOE | mir-124a-2, Human |
| 338696 | 523 | CTTCAAGTGCAGCCGTAGGC | uniform MOE | mir-124a-2, Human |
| 338697 | 524 | TGCCATGAGATTCAACAGTC | uniform MOE | mir-21, Human |
| 338698 | 525 | ACATTGCTATCATAAGAGCT | uniform MOE | mir-16-1, Human |
| 338699 | 526 | TAATTTTAGAATCTTAACGC | uniform MOE | mir-16-1, Human |
| 338700 | 527 | AGTGTCTCATGGCAAACTTA | uniform MOE | mir-144, Human |
| 338701 | 528 | TGTTGCCTAACGAACACAGA | uniform MOE | mir-221, Human |
| 338702 | 529 | GCTGATTACGAAAGACAGGA | uniform MOE | mir-222, Human |
| 338703 | 530 | GCTTAGCTGTGTCTTACAGC | uniform MOE | mir-30d, Human |
| 338704 | 531 | GAGGATGTCTGTGAATAGCC | uniform MOE | mir-30d, Human |
| 338705 | 532 | CCACATATACATATATACGC | uniform MOE | mir-19b-2, Human |
| 338706 | 533 | AGGAAGCACACATTATCACA | uniform MOE | mir-19b-2, Human |
| 338707 | 534 | GACCTGCTACTCACTCTCGT | uniform MOE | mir-128b, Human |
| 338708 | 535 | GGTTGGCCGCAGACTCGTAC | uniform MOE | hypothetical miRNA 069/mir-219-2, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338709 | 536 | GATGTCACTGAGGAAATCAC | uniform MOE | hypothetical miRNA-070, Human |
| 338710 | 537 | TCAGTTGGAGGCAAAAACCC | uniform MOE | LOC 114614/ hypothetical miRNA-071, Human |
| 338711 | 538 | GGTAGTGCAGCGCAGCTGGT | uniform MOE | mir-29b-2, Human |
| 338712 | 539 | CCGGCTATTGAGTTATGTAC | uniform MOE | mir-129-2, Human |
| 338713 | 540 | ACCTCTCAGGAAGACGGACT | uniform MOE | mir-133b, Human |
| 338714 | 541 | GAGCATGCAACACTCTGTGC | uniform MOE | hypothetical miRNA-075, Human |
| 338715 | 542 | CCTCCTTGTGGGCAAAATCC | uniform MOE | let-7d, Human |
| 338716 | 543 | CGCATCTTGACTGTAGCATG | uniform MOE | mir-15b, Human |
| 338717 | 544 | TCTAAGGGGTCACAGAAGGT | uniform MOE | mir-29a-1, Human |
| 338718 | 545 | GAAAATTATATTGACTCTGA | uniform MOE | mir-29a-1, Human |
| 338719 | 546 | GGTTCCTAATTAAACAACCC | uniform MOE | hypothetical miRNA-079, Human |
| 338720 | 547 | CCGAGGGTCTAACCCAGCCC | uniform MOE | mir-199b, Human |
| 338721 | 548 | GACTACTGTTGAGAGGAACA | uniform MOE | mir-129-1, Human |
| 338722 | 549 | TCTCCTTGGGTGTCCTCCTC | uniform MOE | let-7e, Human |
| 338723 | 550 | TGCTGACTGCTCGCCCTTGC | uniform MOE | hypothetical miRNA-083, Human |
| 338724 | 551 | ACTCCCAGGGTGTAACTCTA | uniform MOE | let7c-1, Human |
| 338725 | 552 | CATGAAGAAAGACTGTAGCC | uniform MOE | mir-204, Human |
| 338726 | 553 | GACAAGGTGGGAGCGAGTGG | uniform MOE | mir-145, Human |
| 338727 | 554 | TGCTCAGCCAGCCCCATTCT | uniform MOE | mir-124a-1, Human |
| 338728 | 555 | GCTTTTAGAACCACTGCCTC | uniform MOE | DiGeorge syndrome critical region gene 8/ hypothetical miRNA-088, Human |
| 338729 | 556 | GGAGTAGATGATGGTTAGCC | uniform MOE | mir-213/mir-181a, Human |
| 338730 | 557 | ACTGATTCAAGAGCTTTGTA | uniform MOE | hypothetical miRNA-090, Human |
| 338731 | 558 | GTAGATAACTAAACACTACC | uniform MOE | mir-20, Human |
| 338732 | 559 | AATCCATTGAAGAGGCGATT | uniform MOE | mir-133a-1, Human |
| 338733 | 560 | GGTAAGAGGATGCGCTGCTC | uniform MOE | mir-138-2, Human |
| 338734 | 561 | GGCCTAATATCCCTACCCCA | uniform MOE | mir-98, Human |
| 338735 | 562 | GTGTTCAGAAACCCAGGCCC | uniform MOE | mir-196-1, Human |
| 338736 | 563 | TCCAGGATGCAAAAGCACGA | uniform MOE | mir-125b-1, Human |
| 338737 | 564 | TACAACGGCATTGTCCTGAA | uniform MOE | mir-199a-2, Human |
| 338738 | 565 | TTTCAGGCTCACCTCCCCAG | uniform MOE | hypothetical miRNA-099, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338739 | 566 | AAAAATAATCTCTGCACAGG | uniform MOE | mir-181b, Human |
| 338740 | 567 | AGAATGAGTTGACATACCAA | uniform MOE | hypothetical miRNA-101, Human |
| 338741 | 568 | GCTTCACAATTAGACCATCC | uniform MOE | mir-141, Human |
| 338742 | 569 | AGACTCCACACCACTCATAC | uniform MOE | mir-131-1/miR-9, Human |
| 338743 | 570 | ATCCATTGGACAGTCGATTT | uniform MOE | mir-133a-2, Human |
| 338744 | 571 | GGCGGGCGGCTCTGAGGCGG | uniform MOE | hypothetical miRNA-105, Human |
| 338745 | 572 | CTCTTTAGGCCAGATCCTCA | uniform MOE | hypothetical miRNA-105, Human |
| 338746 | 573 | TAATGGTATGTGTGGTGATA | uniform MOE | hypothetical mirNA-107, Human |
| 338747 | 574 | ATTACTAAGTTGTTAGCTGT | uniform MOE | miR-1d-2, Human |
| 338748 | 575 | GATGCTAATCTACTTCACTA | uniform MOE | mir-18, Human |
| 338749 | 576 | TCAGCATGGTGCCCTCGCCC | uniform MOE | mir-220, Human |
| 338750 | 577 | TCCGCGGGGCGGGGAGGCT | uniform MOE | hypothetical miRNA-111, Human |
| 338751 | 578 | AGACCACAGCCACTCTAATC | uniform MOE | mir-7-3, Human |
| 338752 | 579 | TCCGTTTCCATCGTTCCACC | uniform MOE | mir-218-2, Human |
| 338753 | 580 | GCCAGTGTACACAAACCAAC | uniform MOE | mir-24-2, Human |
| 338754 | 581 | AAGGCTTTTGCTCAAGGGC | uniform MOE | chromosome 9 ORF3 containing mir-23b, mir-24-2 and mir-27b, Human |
| 338755 | 582 | TTGACCTGAATGCTACAAGG | uniform MOE | mir-103-2, Human |
| 338756 | 583 | TGCCCTGCTCAGAGCCCTAG | uniform MOE | mir-211, Human |
| 338757 | 584 | TCAATGTGATGGCACCACCA | uniform MOE | mir-101-3, Human |
| 338758 | 585 | ACCTCCCAGCCAATCCATGT | uniform MOE | mir-30b, Human |
| 338759 | 586 | TCCTGGATGATATCTACCTC | uniform MOE | hypothetical miRNA-120, Human |
| 338760 | 587 | TCTCCCTTGATGTAATTCTA | uniform MOE | let-7a-4, Human |
| 338761 | 588 | AGAGCGGAGTGTTTATGTCA | uniform MOE | mir-10a, Human |
| 338762 | 589 | TCATTCATTTGAAGGAAATA | uniform MOE | mir-19a, Human |
| 338763 | 590 | TCCAAGATGGGGTATGACCC | uniform MOE | let-7f-2, Human |
| 338764 | 591 | TTTTTAAACACACATTCGCG | uniform MOE | mir-15a-1, Human |
| 338765 | 592 | AGATGTGTTTCCATTCCACT | uniform MOE | mir-108-2, Human |
| 338766 | 593 | CCCCCTGCCGCTGGTACTCT | uniform MOE | mir-137, Human |
| 338767 | 594 | CGGCCGGAGCCATAGACTCG | uniform MOE | mir-219-1, Human |
| 338768 | 595 | CTTTCAGAGAGCCACAGCCT | uniform MOE | mir-148b, Human |
| 338769 | 596 | GCTTCCCAGCGGCCTATAGT | uniform MOE | mir-130b, Human |
| 338770 | 597 | CAGCAGAATATCACACAGCT | uniform MOE | mir-19b-1, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338771 | 598 | TACAATTTGGGAGTCCTGAA | uniform MOE | mir-199b, Human |
| 338772 | 599 | GCCTCCTTCATATATTCTCA | uniform MOE | mir-204, Human |
| 338773 | 600 | CCCCATCTTAGCATCTAAGG | uniform MOE | mir-145, Human |
| 338774 | 601 | TTGTATGGACATTTAAATCA | uniform MOE | mir-124a-1, Human |
| 338775 | 602 | TTTGATTTTAATTCCAAACT | uniform MOE | mir-213/mir-181a, Human |
| 338776 | 603 | CAAACGGTAAGATTTGCAGA | uniform MOE | hypothetical miRNA-090, Human |
| 338777 | 604 | GGATTTAAACGGTAAACATC | uniform MOE | mir-125b-1, Human |
| 338778 | 605 | CTCTAGCTCCCTCACCAGTG | uniform MOE | hypothetical miRNA-099, Human |
| 338779 | 606 | GCTTGTCCACACAGTTCAAC | uniform MOE | mir-181b, Human |
| 338780 | 607 | GCATTGTATGTTCATATGGG | uniform MOE | miR-1d-2, Human |
| 338781 | 608 | TGTCGTAGTACATCAGAACA | uniform MOE | mir-7-3, Human |
| 338782 | 609 | AGCCAGTGTGTAAAATGAGA | uniform MOE | chromosome 9 ORF3 containing mir-23b, mir-24-2 and mir-27b, Human |
| 338783 | 610 | TTCAGATATACAGCATCGGT | uniform MOE | mir-101-3, Human |
| 338784 | 611 | TGACCACAAAATTCCTTACA | uniform MOE | mir-10a, Human |
| 338785 | 612 | ACAACTACATTCTTCTTGTA | uniform MOE | mir-19a, Human |
| 338786 | 613 | TGCACCTTTTCAAAATCCAC | uniform MOE | mir-15a-1, Human |
| 338787 | 614 | AACGTAATCCGTATTATCCA | uniform MOE | mir-137, Human |
| 338788 | 615 | CGTGAGGGCTAGGAAATTGC | uniform MOE | mir-216, Human |
| 338789 | 616 | GCAACAGGCCTCAATATCTT | uniform MOE | mir-100-1, Human |
| 338790 | 617 | ACGAGGGGTCAGAGCAGCGC | uniform MOE | mir-187, Human |
| 338791 | 618 | GGCAGACGAAAGGCTGACAG | uniform MOE | hypothetical miRNA-137, Human |
| 338792 | 619 | CTGCACCATGTTCGGCTCCC | uniform MOE | hypothetical miRNA-138, Human |
| 338793 | 620 | GGGGCCCTCAGGGCTGGGGC | uniform MOE | mir-124a-3, Human |
| 338794 | 621 | CCGGTCCACTCTGTATCCAG | uniform MOE | mir-7-2, Human |
| 338795 | 622 | GCTGGGAAAGAGAGGGCAGA | uniform MOE | hypothetical miRNA-142, Human |
| 338796 | 623 | TCAGATTGCCAACATTGTGA | uniform MOE | hypothetical miRNA-143, Human |
| 338797 | 624 | CTGGGGAGGGGTTAGCGTC | uniform MOE | collagen, type I, alpha 1/hypothetical miRNA-144, Human |
| 338798 | 625 | TGGGTCTGGGGCAGCGCAGT | uniform MOE | mir-210, Human |
| 338799 | 626 | TTGAAGTAGCACAGTCATAG | uniform MOE | mir-215, Human |
| 338800 | 627 | TCTACCACATGGAGTGTCCA | uniform MOE | mir-223, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338801 | 628 | AGTGCCGCTGCCGCGCCGTG | uniform MOE | mir-131-3/miR-9, Human |
| 338802 | 629 | ACACATTGAGAGCCTCCTGA | uniform MOE | mir-199a-1, Human |
| 338803 | 630 | GTCGCTCAGTGCTCTCTAGG | uniform MOE | mir-30c-1, Human |
| 338804 | 631 | AGGCTCCTCTGATGGAAGGT | uniform MOE | mir-101-1, Human |
| 338805 | 632 | GCTGTGACTTCTGATATTAT | uniform MOE | hypothetical miRNA-153, Human |
| 338806 | 633 | GACATCATGTGATTTGCTCA | uniform MOE | hypothetical miRNA-154, Human |
| 338807 | 634 | CACCCCAAGGCTGCAGGGCA | uniform MOE | mir-26b, Human |
| 338808 | 635 | TGTCAAGCCTGGTACCACCA | uniform MOE | hypothetical miRNA-156, Human |
| 338809 | 636 | CTGCTCCAGAGCCCGAGTCG | uniform MOE | mir-152, Human |
| 338810 | 637 | ACCCTCCGCTGGCTGTCCCC | uniform MOE | mir-135-1, Human |
| 338811 | 638 | TAGAGTGAATTTATCTTGGT | uniform MOE | non-coding RNA in rhabdomyosarcoma/mir-135-2, Human |
| 338812 | 639 | TGGTGACTGATTCTTATCCA | uniform MOE | mir-217, Human |
| 338813 | 640 | CAATATGATTGGATAGAGGA | uniform MOE | hypothetical miRNA-161, Human |
| 338814 | 641 | TTTAAACACACATTCGCGCC | uniform MOE | mir-15a-1, Human |
| 338815 | 642 | ACCGGGTGGTATCATAGACC | uniform MOE | let-7g, Human |
| 338816 | 643 | TGCATACCTGTTCAGTTGGA | uniform MOE | hypothetical miRNA-164, Human |
| 338817 | 644 | GCCCGCCTCTCTCGGCCCCC | uniform MOE | sterol regulatory element-binding protein-1/mir-33b, Human |
| 338818 | 645 | TCGCGCCCTCCCAGGCCTCT | uniform MOE | hypothetical miRNA-166, Human |
| 338819 | 646 | ACAACTGTAGAGTATGGTCA | uniform MOE | mir-16-1, Human |
| 338820 | 647 | GCTGACCATCAGTACTTTCC | uniform MOE | hypothetical miRNA 168-1/similar to ribosomal protein L5, Human |
| 338821 | 648 | TTATAGAACAGCCTCCAGTG | uniform MOE | forkhead box P2/hypothetical miRNA-169, Human |
| 338822 | 649 | TTCAGGCACTAGCAGTGGGT | uniform MOE | hypothetical miRNA-170, Human |
| 338823 | 650 | AGTACTGCGAGGTTAACCGC | uniform MOE | glutamate receptor, ionotropic, AMPA 2/ hypothetical miRNA-171, Human |
| 338824 | 651 | GGACCTTTAAGATGCAAAGT | uniform MOE | hypothetical miRNA-172, Human |
| 338825 | 652 | TTCATATTATCCACCCAGGT | uniform MOE | hypothetical miRNA-173, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338826 | 653 | CGGATCCTGTTACCTCACCA | uniform MOE | mir-182, Human |
| 338827 | 654 | TGGTGCCTGCCACATCTTTG | uniform MOE | hypothetical miRNA-175, Human |
| 338828 | 655 | TGGGAGGCTGAATCAAGGAC | uniform MOE | hypothetical miRNA-176, Human |
| 338829 | 656 | TGACAACCAGGAAGCTTGTG | uniform MOE | hypothetical miRNA-177-1, Human |
| 338830 | 657 | GCCAGGCAGCGAGCTTTTGA | uniform MOE | hypothetical miRNA-178, Human |
| 338831 | 658 | CAGCCTGCCACCGCCGCTTT | uniform MOE | hypothetical miRNA-179, Human |
| 338832 | 659 | CTGCCCCGTGGACCGAACA | uniform MOE | cezanne 2/hypothetical miRNA-180, Human |
| 338833 | 660 | TCGTGCACCTGAGGAGTCTG | uniform MOE | hypothetical miRNA-181, Human |
| 338834 | 661 | CAAACGTGCTGTCTTCCTCC | uniform MOE | mir-148a, Human |
| 338835 | 662 | AAGGACTCAGCAGTGTTTCA | uniform MOE | tight junction protein 1 (zona occludens 1)/hypothetical miRNA-183, Human |
| 338836 | 663 | TCCTCGGTGGCAGAGCTCAG | uniform MOE | mir-23a, Human |
| 338837 | 664 | AGACAATGAGTACACAGTTC | uniform MOE | hypothetical miRNA-185, Human |
| 338838 | 665 | CTGCAAGCACTGGTTCCCAT | uniform MOE | hypothetical miRNA-177-2/hypothetical miRNA 186, Human |
| 338839 | 666 | TTGCCTGAGCTGCCCAAACT | uniform MOE | mir-181c, Human |
| 338840 | 667 | TCCATCACACTGTCCTATGA | uniform MOE | hypothetical miRNA-188, Human |
| 338841 | 668 | GAGGGATTGTATGAACATCT | uniform MOE | mir-216, Human |
| 338842 | 669 | GCTTGTGCGGACTAATACCA | uniform MOE | mir-100-1, Human |
| 338843 | 670 | GCAGGCTAAAAGAAATAAGC | uniform MOE | hypothetical miRNA-138, Human |
| 338844 | 671 | ATTGTATAGACATTAAATCA | uniform MOE | mir-124a-3, Human |
| 338845 | 672 | GTTGAGCGCAGTAAGACAAC | uniform MOE | mir-7-2, Human |
| 338846 | 673 | AGATGTTTCTGGCCTGCGAG | uniform MOE | hypothetical miRNA-142, Human |
| 338847 | 674 | GACAAACTCAGCTATATTGT | uniform MOE | mir-215, Human |
| 338848 | 675 | ACGGCTCTGTGGCACTCATA | uniform MOE | mir-131-3/miR-9, Human |
| 338849 | 676 | GCTTTCTTACTTTCCACAGC | uniform MOE | mir-30c-1, Human |
| 338850 | 677 | TACCTTTAGAATAGACAGCA | uniform MOE | mir-101-1, Human |
| 338851 | 678 | AGGCTGGACAGCACACAACC | uniform MOE | mir-26b, Human |
| 338852 | 679 | AGCAGGAGCCTTATCTCTCC | uniform MOE | hypothetical miRNA-156, Human |
| 338853 | 680 | ATGAGTGAGCAGTAGAATCA | uniform MOE | mir-135-1, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 338854 | 681 | TGAGACTTTATTACTATCAC | uniform MOE | non-coding RNA in rhabdomyosarcoma/mir-135-2, Human |
| 338855 | 682 | TACTTTACTCCAAGGTTTTA | uniform MOE | mir-15a-1, Human |
| 338856 | 683 | GCACCCGCCTCACACACGTG | uniform MOE | sterol regulatory element-binding protein-1/mir-33b, Human |
| 338857 | 684 | TTCCCGACCTGCCTTTACCT | uniform MOE | hypothetical miRNA-166, Human |
| 338858 | 685 | TCCTGTAATTATAGGCTAGC | uniform MOE | forkhead box P2/hypothetical miRNA-169, Human |
| 338859 | 686 | GGATCATATCAATAATACCA | uniform MOE | hypothetical miRNA-172, Human |
| 338860 | 687 | TGCTGAGACACACAATATGT | uniform MOE | hypothetical miRNA-176, Human |
| 338861 | 688 | TGTTTGTCTCCAAGAAACGT | uniform MOE | hypothetical miRNA-177-1, Human |
| 338862 | 689 | TGTCATGGACAGGATGAATA | uniform MOE | hypothetical miRNA-179, Human |
| 338863 | 690 | TCTATCATACTCAGAGTCGG | uniform MOE | mir-148a, Human |
| 338864 | 691 | TTGTGACAGGAAGCAAATCC | uniform MOE | mir-23a, Human |
| 338865 | 692 | CATCAGAGTCACCAACCGCA | uniform MOE | hypothetical miRNA-185, Human |
| 338866 | 693 | CAAGAGATGTCTCGTTTTGC | uniform MOE | hypothetical miRNA-177-2/hypothetical miRNA 186, Human |
| 340342 | 937 | GACTGTTGAATCTCATGGCA | uniform MOE | miR-104 (Mourelatos), Human |
| 340344 | 1656 | GCATGAGCAGCCACCACAGG | uniform MOE | miR-105 (Mourelatos), Human |
| 340346 | 1626 | ACGACTTGGTGTGGACCCTG | uniform MOE | miR-27 (Mourelatos), Human |
| 340347 | 849 | TACTTTATATAGAACACAAG | uniform MOE | mir-92-2/miR-92 (Mourelatos), Human |
| 340349 | 1632 | AGGTTGGGTAATCACACTAC | uniform MOE | miR-93 (Mourelatos), Human |
| 340351 | 1621 | AATGTAACGCATTTCAATTC | uniform MOE | miR-95 (Mourelatos), Human |
| 340353 | 1694 | TGTGCGGTCCACTTCACCAC | uniform MOE | miR-99 (Mourelatos), Human |
| 340355 | 1671 | GTCCAGCAATTGCCCAAGTC | uniform MOE | miR-25, Human |
| 340357 | 1662 | GGAAAGTCAGAAAGGTAACT | uniform MOE | miR-28, Human |
| 340359 | 1635 | CAGGTTCCCAGTTCAACAGC | uniform MOE | miR-31, Human |
| 340361 | 1636 | CATTGAGGCCGTGACAACAT | uniform MOE | miR-32, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 340363 | 1656 | GCATGAGCAGCCACCACAGG | 5-10-5 MOE gapmer | miR-105 (Mourelatos), Human |
| 340364 | 1626 | ACGACTTGGTGTGGACCCTG | 5-10-5 MOE gapmer | miR-27 (Mourelatos), Human |
| 340366 | 1632 | AGGTTGGGTAATCACACTAC | 5-10-5 MOE gapmer | miR-93 (Mourelatos), Human |
| 340367 | 1621 | AATGTAACGCATTTCAATTC | 5-10-5 MOE gapmer | miR-95 (Mourelatos), Human |
| 340368 | 1694 | TGTGCGGTCCACTTCACCAC | 5-10-5 MOE gapmer | miR-99 (Mourelatos), Human |
| 340369 | 1671 | GTCCAGCAATTGCCCAAGTC | 5-10-5 MOE gapmer | miR-25, Human |
| 340370 | 1662 | GGAAAGTCAGAAAGGTAACT | 5-10-5 MOE gapmer | miR-28, Human |
| 340371 | 1635 | CAGGTTCCCAGTTCAACAGC | 5-10-5 MOE gapmer | miR-31, Human |
| 340372 | 1636 | CATTGAGGCCGTGACAACAT | 5-10-5 MOE gapmer | miR-32, Human |
| 341817 | 1630 | AGCCACCTTGAGCTCACAGC | uniform MOE | miR-30c-2, Human |
| 341818 | 1695 | TGTGTGCGGCGAAGGCCCCG | uniform MOE | miR-99b, Human |
| 341819 | 1657 | GCCAGGCTCCCAAGAAGCTC | uniform MOE | MiR-125a, Human |
| 341820 | 1653 | GATGTTACTAAAATACCTCA | uniform MOE | MiR-125b-2, Human |
| 341822 | 1679 | TCCGATGATCTTTCTGAATC | uniform MOE | miR-127, Human |
| 341825 | 1646 | CTTAAAATAAAACCAGAAAG | uniform MOE | miR-186, Human |
| 341826 | 1618 | AAAATCACAGGAACCTATCT | uniform MOE | miR-198, Human |
| 341827 | 1688 | TGGAATGCTCTGGAGACAAC | uniform MOE | miR-191, Human |
| 341828 | 1677 | TCCATAGCAAAGTAATCCAT | uniform MOE | miR-206, Human |
| 341829 | 1668 | GGTAGCACGGAGAGGACCAC | uniform MOE | miR-94, Human |
| 341830 | 1624 | ACACTTACAGTCACAAAGCT | uniform MOE | miR-184, Human |
| 341831 | 1654 | GCAGACTCGCTTCCCTGTGC | uniform MOE | miR-195, Human |
| 341832 | 1684 | TGATCCGACACCCTCATCTC | uniform MOE | miR-193, Human |
| 341833 | 1641 | CCTGGGGAGGGGACCATCAG | uniform MOE | miR-185, Human |
| 341834 | 1676 | TCAGAAAGCTCACCCTCCAC | uniform MOE | miR-188, Human |
| 341835 | 1648 | GAGCTCTTACCTCCCAGTGC | uniform MOE | miR-197, Human |
| 341836 | 1686 | TGGAAATTGGTACACAGTCC | uniform MOE | miR-194-1, Human |
| 341837 | 1642 | CGTGAGCATCAGGTATAACC | uniform MOE | miR-208, Human |
| 341838 | 1687 | TGGAACCAGTGGGCACTTCC | uniform MOE | miR-194-2, Human |
| 341839 | 1638 | CCAGCCTCCGAGCCACACTG | uniform MOE | miR-139, Human |
| 341840 | 1628 | AGACCTGACTCCATCCAATG | uniform MOE | miR-200b, Human |
| 341841 | 1629 | AGAGTCAAGCTGGGAAATCC | uniform MOE | miR-200a, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 341843 | 1630 | AGCCACCTTGAGCTCACAGC | 5-10-5 MOE gapmer | miR-30c-2, Human |
| 341844 | 1695 | TGTGTGCGGCGAAGGCCCCG | 5-10-5 MOE gapmer | miR-99b, Human |
| 341845 | 1657 | GCCAGGCTCCCAAGAACCTC | 5-10-5 MOE gapmer | MiR-125a, Human |
| 341846 | 1653 | GATGTTACTAAAATACCTCA | 5-10-5 MOE gapmer | MiR-125b-2, Human |
| 341848 | 1679 | TCCGATGATCTTTCTGAATC | 5-10-5 MOE gapmer | miR-127, Human |
| 341851 | 1646 | CTTAAAATAAAACCAGAAAG | 5-10-5 MOE gapmer | miR-186, Human |
| 341852 | 1618 | AAAATCACAGGAACCTATCT | 5-10-5 MOE gapmer | miR-198, Human |
| 341853 | 1688 | TGGAATGCTCTGGAGACAAC | 5-10-5 MOE gapmer | miR-191, Human |
| 341854 | 1677 | TCCATAGCAAAGTAATCCAT | 5-10-5 MOE gapmer | miR-206, Human |
| 341855 | 1668 | GGTAGCACGGAGAGGACCAC | 5-10-5 MOE gapmer | miR-94, Human |
| 341856 | 1624 | ACACTTACAGTCACAAAGCT | 5-10-5 MOE gapmer | miR-184, Human |
| 341857 | 1654 | GCAGACTCGCTTCCCTGTGC | 5-10-5 MOE gapmer | miR-195, Human |
| 341858 | 1684 | TGATCCGACACCCTCATCTC | 5-10-5 MOE gapmer | miR-193, Human |
| 341859 | 1641 | CCTGGGGAGGGGACCATCAG | 5-10-5 MOE gapmer | miR-185, Human |
| 341860 | 1676 | TCAGAAAGCTCACCCTCCAC | 5-10-5 MOE gapmer | miR-188, Human |
| 341861 | 1648 | GAGCTCTTACCTCCCACTGC | 5-10-5 MOE gapmer | miR-197, Human |
| 341862 | 1686 | TGGAAATTGGTACACAGTCC | 5-10-5 MOE gapmer | miR-194-1, Human |
| 341863 | 1642 | CGTGAGCATCAGGTATAACC | 5-10-5 MOE gapmer | miR-208, Human |
| 341864 | 1687 | TGGAACCAGTGGGCACTTCC | 5-10-5 MOE gapmer | miR-194-2, Human |
| 341865 | 1638 | CCAGCCTCCGAGCCACACTG | 5-10-5 MOE gapmer | miR-139, Human |
| 341866 | 1628 | AGACCTGACTCCATCCAATG | 5-10-5 MOE gapmer | miR-200b, Human |
| 341867 | 1629 | AGAGTCAAGCTGGGAAATCC | 5-10-5 MOE gapmer | miR-200a, Human |
| 344731 | 1619 | AACGGTTTATGACAAACATT | uniform MOE | mir-240* (Kosik), Human |
| 344732 | 1665 | GGGCTGTATGCACTTTCTCC | uniform MOE | mir-232* (Kosik), Human |
| 344733 | 1667 | GGGTCTCCAGCTTTACACGA | uniform MOE | mir-227* (Kosik)/mir-226* (Kosik), Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 344734 | 1649 | GAGTCGCCTGAGTCATCACT | uniform MOE | mir-244* (Kosik), Human |
| 344735 | 1658 | GCCATAAATAAAGCGAAGGC | uniform MOE | mir-224* (Kosik), Human |
| 344736 | 1678 | TCCATTAACCATGTCCCTCA | uniform MOE | mir-248* (Kosik), Human |
| 344737 | 1619 | AACGGTTTATGACAAACATT | 5-10-5 MOE gapmer | mir-240* (Kosik), Human |
| 344738 | 1665 | GGGCTGTATGCACTTTCTCC | 5-10-5 MOE gapmer | mir-232* (Kosik), Human |
| 344739 | 1667 | GGGTCTCCAGCTTTACACCA | 5-10-5 MOE gapmer | mir-227* (Kosik)/mir-226* (Kosik), Human |
| 344740 | 1649 | GAGTCGCGTGAGTCATCACT | 5-10-5 MOE gapmer | mir-244* (Kosik), Human |
| 344741 | 1658 | GCCATAAATAAAGCGAACGC | 5-10-5 MOE gapmer | mir-224* (Kosik), Human |
| 344742 | 1678 | TCCATTAACCATGTCCCTCA | 5-10-5 MOE gapmer | mir-248* (Kosik), Human |
| 346787 | 1689 | TGGCTTCCATAGTCTGGTGT | uniform MOE | miR-147 (Sanger), Human |
| 346788 | 1623 | ACAATGCACAATCATCTACT | uniform MOE | miR-224 (Sanger), Human |
| 346789 | 1669 | GGTGAACACAGTGCATGCCC | uniform MOE | miR-134 (Sanger), Human |
| 346790 | 1682 | TCTGACACTGACACAACCCA | uniform MOE | miR-146 (Sanger), Human |
| 346791 | 1631 | AGGGTCTGAGCCCAGCACTG | uniform MOE | miR-150 (Sanger), Human |
| 346792 | 1637 | CCAAGAGACGTTTCATTTTG | uniform MOE | hypothetical miRNA-177-3, Human |
| 346793 | 1683 | TCTGATTGGCAACGGCCTGA | uniform MOE | mir-138-3, Human |
| 346794 | 1627 | ACTGTCCATCTTAGTTCAGA | uniform MOE | mir-138-4, Human |
| 346795 | 1634 | AGTTGATTCAGACTCAAACC | uniform MOE | mir-181b-2, Human |
| 346796 | 1655 | GCATAAGCAGCCACCACAGG | uniform MOE | miR-105-2, Human |
| 346797 | 1691 | TGTATGATATCTACCTCAGG | uniform MOE | hypothetical miRNA-120-2, Human |
| 346798 | 1689 | TGGCTTCCATAGTCTGGTGT | 5-10-5 MOE gapmer | miR-147 (Sanger), Human |
| 346799 | 1623 | ACAATGCACAATCATCTACT | 5-10-5 MOE gapmer | miR-224 (Sanger), Human |
| 346800 | 1669 | GGTGAACACAGTGCATGCCC | 5-10-5 MOE gapmer | miR-134 (Sanger), Human |
| 346801 | 1682 | TCTGACACTGACACAACCCA | 5-10-5 MOE gapmer | miR-146 (Sanger), Human |
| 346802 | 1631 | AGGGTCTGAGCCCAGCACTG | 5-10-5 MOE gapmer | miR-150 (Sanger), Human |
| 346803 | 1637 | CCAAGAGACGTTTCATTTTG | 5-10-5 MOE gapmer | hypothetical miRNA-177-3, Human |
| 346804 | 1683 | TCTGATTGGCAACGGCCTGA | 5-10-5 MOE gapmer | mir-138-3, Human |
| 346805 | 1627 | ACTGTCCATCTTAGTTCAGA | 5-10-5 MOE gapmer | mir-138-4, Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 346806 | 1634 | AGTTGATTCAGACTCAAACC | 5-10-5 MOE gapmer | mir-181b-2, Human |
| 346807 | 1655 | GCATAAGCAGCCACCACAGG | 5-10-5 MOE gapmer | miR-105-2, Human |
| 346808 | 1691 | TGTATGATATCTACCTCAGG | 5-10-5 MOE gapmer | hypothetical miRNA-120-2, Human |
| 348225 | 1620 | AAGAGAAGGCGGAGGGGAGC | 5-10-5 MOE gapmer | miR-320, Human |
| 348226 | 1643 | CTCGAACCCACAATCCCTGG | 5-10-5 MOE gapmer | miR-321-1, Human |
| 354006 | 1650 | GAGTTTGGGACAGCAATCAC | 5-10-5 MOE gapmer | mir-135b (Ruvkun), Human |
| 354007 | 1633 | AGTAGGGGATGAGACATACT | 5-10-5 MOE gapmer | mir-151* (Ruvkun), Human |
| 354008 | 1639 | CCCACAAACGACATATGACA | 5-10-5 MOE gapmer | mir-340 (Ruvkun), Human |
| 354009 | 1664 | GGCCTGGTTTGATCTGGGAT | 5-10-5 MOE gapmer | mir-331 (Ruvkun), Human |
| 354010 | 1647 | GAGACTCCCAACCGCACCCA | 5-10-5 MOE gapmer | miR-200c (RFAM-Human) |
| 354011 | 1700 | TTGTAACCACCACAGTACAA | 5-10-5 MOE gapmer | miR-34b (RFAM-Human) |
| 354012 | 1663 | GGAGGACAGGGAGAGCGGCC | 5-10-5 MOE gapmer | mir-339-1 (RFAM-Human) |
| 354013 | 1675 | TCACAGGCAGGCACACGTGA | 5-10-5 MOE gapmer | mir-339-1 (RFAM-Human) |
| 354014 | 1698 | TTCAGAGCTACAGCATCGGT | 5-10-5 MOE gapmer | mir-101-3, Mouse |
| 354015 | 1670 | GTAGAACTCAAAAAGCTACC | 5-10-5 MOE gapmer | mir-106, Mouse |
| 354016 | 1673 | TAGATGCACACATCACTACC | 5-10-5 MOE gapmer | miR-17/mir-91, Mouse |
| 354017 | 1690 | TGTACAATTTGGGAGTCCTG | 5-10-5 MOE gapmer | mir-199b, Human |
| 354018 | 1644 | CTCTTTAGACCAGATCCACA | 5-10-5 MOE gapmer | hypothetical miRNA-105, Mouse |
| 354019 | 1640 | CCTCACTCAGAGGCCTAGGC | 5-10-5 MOE gapmer | mir-211, Mouse |
| 354020 | 1666 | GGGGATTAAGTCTTATCCAG | 5-10-5 MOE gapmer | mir-217, Mouse |
| 354021 | 1622 | ACAATGCACAAACCATCTAC | 5-10-5 MOE gapmer | miR-224 (Sanger), Mouse |
| 354022 | 1693 | TGTCATATCATATCAGAACA | 5-10-5 MOE gapmer | mir-7-3, Mouse |
| 354023 | 1672 | TAGATGACGACACACTACCT | 5-10-5 MOE gapmer | mir-20, Rat |
| 354024 | 1692 | TGTCACAAACACTTACTGGA | 5-10-5 MOE gapmer | mir-325 (Ruvkun), Human |

TABLE 64-continued

Phosphorothioate oligomeric compounds targeting pri-miRNAs

| ISIS # | SEQ ID NO | sequence | chemistry | Pri-miRNA |
|---|---|---|---|---|
| 354025 | 1625 | ACGAATTATGTCACAAACAC | 5-10-5 MOE gapmer | mir-325 (Ruvkun), Mouse |
| 354026 | 1651 | GATCTGAGCACCACCCGCCT | 5-10-5 MOE gapmer | mir-326 (Ruvkun), Human |
| 354027 | 1652 | GATCTGAGCATAACCCGCCT | 5-10-5 MOE gapmer | mir-326 (Ruvkun), Mouse |
| 354028 | 1697 | TGTTTCGTCCTCATTAAAGA | 5-10-5 MOE gapmer | mir-329-1 (Ruvkun), Human |
| 354029 | 1699 | TTCTCATCAAAGAAACAGAG | 5-10-5 MOE gapmer | mir-329-1 (Ruvkun), Mouse |
| 354030 | 1696 | TGTTTCGTCCTCAATAAAGA | 5-10-5 MOE gapmer | mir-329-2 (Ruvkun), Human |
| 354031 | 1681 | TCGGTTGATCTTGCAGAGCC | 5-10-5 MOE gapmer | mir-330 (Ruvkun), Human |
| 354032 | 1685 | TGCTCGTTGGATCTTGAAGA | 5-10-5 MOE gapmer | mir-330 (Ruvkun), Mouse |
| 354033 | 1661 | GCTGGATAACTGTGCATCAA | 5-10-5 MOE gapmer | mir-337 (Ruvkun), Human |
| 354034 | 1645 | CTGAATGGCTGTGCAATCAA | 5-10-5 MOE gapmer | mir-337 (Ruvkun), Mouse |
| 354035 | 1659 | GCCCACGAGCCATGACGAGC | 5-10-5 MOE gapmer | mir-345 (Ruvkun), Human |
| 354036 | 1660 | GCCCAGTAGCCACCACAAGC | 5-10-5 MOE gapmer | mir-345 (Ruvkun), Mouse |
| 354037 | 1680 | TCCTTCAGAGCAACAGAGAG | 5-10-5 MOE gapmer | mir-346 (Ruvkun), Human |
| 354038 | 1674 | TAGTAGGGAGGAGACATAC | 5-10-5 MOE gapmer | mir-151* (Ruvkun), Mouse |
| 354039 | 1701 | TTGTCAGCACCGCACTACAA | 5-10-5 MOE gapmer | miR-34b (RFAM-Mouse) |

In accordance with the present invention, a further series of oligomeric compounds were designed and synthesized to target different regions of miRNAs. These oligomeric compounds can be analyzed for their effect on miRNA, pre-miRNA or pri-miRNA levels by quantitative real-time PCR, or they can be used in other assays to investigate the role of miRNAs or miRNA downstream targets. The compounds are shown in Table 65, where "pri-miRNA" indicates the particular pri-miRNA which contains the miRNA that the oligomeric compound was designed to target. Oligomeric compounds having phosphorothioate internucleoside linkages are indicated by "PS" in the "Chemistry" column of Table 65, whereas compounds having phosphodiester internucleoside linkages are indicated by "PO." In some embodiments, chimeric oligonucleotides ("gapmers") are composed of a central "gap" region consisting of ten 2'-deoxynucleotides, which is flanked on both sides (5' and 3' directions) by nucleotide "wings" two to ten nucleotides in length. The wings are composed of 2'-methoxyethoxy (2'-MOE) ribonucleotides. In some embodiments, chimeric oligonucleotides are of the "open end" type wherein the "gap" segment is located at either the 3' or 5' terminus of the oligomeric compound. Chimeric oligonucleotides of this type are also known in the art and are indicated in Table 65 as "hemimers." For example, "PO/6MOE-10deoxy hemimer," describes a chimeric oligomeric compound consisting of six 2'-MOE ribonucleotides at the 5'-terminus, followed by ten deoxyribonucleotides on the 3'-terminal end, with a phosphodiester backbone throughout the hemimer.

TABLE 65

Oligomeric compounds targeting miRNAs

| ISIS # | SEQ ID NO | sequence | Chemistry | Pri-miRNA |
|---|---|---|---|---|
| 340343 | 1780 | ACAGGAGTCTGAGCATTTGA | PS/MOE | miR-105 (Mourelatos) |
| 340345 | 1882 | GGAACTTAGCCACTGTGAA | PS/MOE | miR-27 (Mourelatos) |
| 340350 | 855 | TGCTCAATAAATACCCCTTGAA | PS/MOE | miR-95 (Mourelatos) |
| 340352 | 1821 | CACAAGATCGGATCTACGGGTT | PS/MOE | miR-99 (Mourelatos) |
| 340354 | 1903 | TCAGACCGAGACAAGTGCAATG | PS/MOE | miR-25 (Tuschl) |
| 340356 | 1853 | CTCAATAGACTGTGAGCTCCTT | PS/MOE | miR-28 (Tuschl) |
| 340358 | 1825 | CAGCTATGCCAGCATCTTGCC | PS/MOE | miR-31 (Tuschl) |
| 340360 | 1865 | GCAACTTAGTAATGTGCAATA | PS/MOE | miR-32 (Tuschl) |
| 340924 | 298 | ACAAATTCGGTTCTACAGGGTA | PS/MOE 5-10-7 gapmer | mir-10b |
| 340925 | 307 | GTGGTAATCCCTGGCAATGTGAT | PS/MOE 5-10-8 gapmer | mir-23b |
| 340928 | 322 | ACTCACCGACAGCGTTGAATGTT | PS/MOE 5-10-8 gapmer | mir-181a |
| 340929 | 331 | AACCGATTTCAAATGGTGCTAG | PS/MOE 5-10-7 gapmer | mir-29c |
| 340930 | 342 | GCAAGCCCAGACCGCAAAAG | PS/MOE 5-10-6 gapmer | mir-129 |
| 340931 | 346 | AACCGATTTCAGATGGTGCTAG | PS/MOE 5-10-7 gapmer | mir-29a |
| 340932 | 349 | AACCATACAACCTACTACCTCA | PS/MOE 5-10-7 gapmer | let-7c |
| 340933 | 352 | GGTACAATCAACGGTCGATGGT | PS/MOE 5-0-7 gapmer | mir-213 |
| 340934 | 356 | AACAATACAACTTACTACCTCA | PS/MOE 5-10-7 gapmer | mir-98 |
| 340935 | 373 | GCCCTTTCATCATTGCACTG | PS/MOE 5-10-5 gapmer | mir-130b |
| 340936 | 385 | ACTGTACAAACTACTACCTCA | PS/MOE 5-10-6 gapmer | let-7g |
| 341785 | 854 | GGAGTGAAGACACGGAGCCAGA | PS/MOE | miR-149 |
| 341786 | 1845 | CGCAAGGTCGGTTCTACGGGTG | PS/MOE | miR-99b |
| 341787 | 852 | CACAGGTTAAAGGGTCTCAGGGA | PS/MOE | miR-125a |
| 341788 | 853 | AGCCAAGCTCAGACGGATCCGA | PS/MOE | miR-127 |
| 341789 | 1909 | TCGATCATCAAAACAAATGGAGT | PS/MOE | miR-136 |
| 341790 | 1843 | CGAAGGCAACACGGATAACCTA | PS/MOE | miR-154 |
| 341791 | 1880 | GCTTCCAGTCGAGGATGTTTACA | PS/MOE | miR-30a-s |
| 341792 | 1911 | TCCGTGGTTCTACCCTGTGGTA | PS/MOE | miR-140-as |
| 341793 | 1836 | CCATAAAGTAGGAAACACTACA | PS/MOE | miR-142-as |
| 341794 | 1761 | AACAGGTAGTCTGAACACTGGG | PS/MOE | miR-199-s |

TABLE 65-continued

Oligomeric compounds targeting miRNAs

| ISIS # | SEQ ID NO | sequence | Chemistry | Pri-miRNA |
|---|---|---|---|---|
| 341795 | 1762 | AACCAATGTGCAGACTACTGTA | PS/MOE | miR-199-as |
| 341796 | 1904 | TCATACAGCTAGATAACCAAAGA | PS/MOE | miR-9 |
| 341797 | 1773 | ACAAGTGCCTTCACTGCAGT | PS/MOE | miR-17 |
| 341798 | 1871 | GCATTATTACTCACGGTACGA | PS/MOE | miR-126a |
| 341799 | 1787 | ACCTAATATATCAAACATATCA | PS/MOE | miR-190 |
| 341800 | 1766 | AAGCCCAAAAGGAGAATTGTTTG | PS/MOE | miR-186 |
| 341801 | 1839 | CCTATCTCCCCTCTGGACC | PS/MOE | miR-198a |
| 341802 | 1806 | AGCTGCTTTTGGGATTCCGTTG | PS/MOE | miR-191c |
| 341803 | 760 | CCACACACTTCCTTACATTCCA | PS/MOE | miR-206d |
| 341804 | 761 | ATCTGCACTGTCAGCACTTT | PS/MOE | miR-94 |
| 341805 | 762 | ACCCTTATCAGTTCTCCGTCCA | PS/MOE | miR-184 |
| 341806 | 763 | GCCAATATTTCTGTGCTGCTA | PS/MOE | miR-195 |
| 341807 | 764 | CTGGGACTTTGTAGGCCAGTT | PS/MOE | miR-193 |
| 341808 | 1861 | GAACTGCCTTTCTCTCCA | PS/MOE | miR-185 |
| 341809 | 1786 | ACCCTCCACCATGCAAGGGATG | PS/MOE | miR-188 |
| 341810 | 1879 | GCTGGGTGGAGAAGGTGGTGAA | PS/MOE | miR-197a |
| 341811 | 1906 | TCCACATGGAGTTGCTGTTACA | PS/MOE | miR-194 |
| 341812 | 1771 | ACAAGCTTTTGCTCGTCTTAT | PS/MOE | miR-208 |
| 341814 | 1887 | GTCATCATTACCAGGCAGTATTA | PS/MOE | miR-200b |
| 341815 | 1831 | CATCGTTACCAGACAGTGTTA | PS/MOE | miR-200a |
| 342946 | 1897 | TAGGAGAGAGAAAAAGACTGA | PS/MOE | miR-14 |
| 342947 | 1827 | CAGCTTTCAAAATGATCTCAC | PS/MOE | miR-Bantam |
| 343875 | 321 | AACTATACAACCTACTACCTCA | PS/MOE | let-7a |
| 344267 | 1769 | ACAAATTCGGATCTACAGGGTA | PS/MOE | miR-10 (Tuschl) |
| 344268 | 1774 | ACACAAATTCGGTTCTACAGGG | PS/MOE | miR-10b (Tuschl) |
| 344269 | 1890 | TAACCGATTTCAAATGGTGCTA | PS/MOE | miR-29c (Tuschl) |
| 344270 | 1867 | GCACGAACAGCACTTTG | PS/MOE | miR-93 (Tuschl) |
| 344271 | 1770 | ACAAGATCGGATCTACGGGT | PS/MOE | miR-99a (Tuschl) |
| 344272 | 1816 | CAAACACCATTGTCACACTCCA | PS/MOE | miR-122a, b (Tuschl) |
| 344273 | 1920 | TGTCAATTCATAGGTCAG | PS/MOE | miR-192 (Tuschl) |
| 344274 | 1832 | CCAACAACATGAAACTACCTA | PS/MOE | miR-196 (Tuschl) |
| 344275 | 1912 | TCTAGTGGTCCTAAACATTTCA | PS/MOE | miR-203 (Tuschl) |
| 344276 | 1828 | CAGGCATAGGATGACAAAGGGAA | PS/MOE | miR-204 (Tuschl) |

TABLE 65-continued

Oligomeric compounds targeting miRNAs

| ISIS # | SEQ ID NO | sequence | Chemistry | Pri-miRNA |
|---|---|---|---|---|
| 344277 | 1767 | AATACATACTTCTTTACATTCCA | PS/MOE | miR-1d (Tuschl) |
| 344278 | 1769 | ACAAATTCGGATCTACAGGGTA | PS/MOE 5-10-7 gapmer | miR-10 (Tuschl) |
| 344279 | 1774 | ACACAAATTCGGTTCTACAGGG | PS/MOE 5-10-7 gapmer | miR-10b (Tuschl) |
| 344280 | 1890 | TAACCGATTTCAAATGGTGCTA | PS/MOE 5-10-7 gapmer | miR-29c (Tuschl) |
| 344281 | 1867 | GCACGAACAGCACTTTG | PS/MOE 5-10-2 gapmer | miR-93 (Tuschl) |
| 344282 | 1770 | ACAAGATCGGATCTACGGGT | PS/MOE 5-10-5 gapmer | miR-99a (Tuschl) |
| 344283 | 1816 | CAAACACCATTGTCACACTCCA | PS/MOE 5-10-7 gapmer | miR-122a, b (Tuschl) |
| 344284 | 1920 | TGTCAATTCATAGGTCAG | PS/MOE 5-10-3 gapmer | miR-192 (Tuschl) |
| 344285 | 1832 | CCAACAACATGAAACTACCTA | PS/MOE 5-10-6 gapmer | miR-196 (Tuschl) |
| 344286 | 1912 | TCTAGTGGTCCTAAACATTTCA | PS/MOE 5-10-7 gapmer | miR-203 (Tuschl) |
| 344287 | 1828 | CAGGCATAGGATGACAAAGGGAA | PS/MOE 5-10-8 gapmer | miR-204 (Tuschl) |
| 344288 | 1767 | AATACATACTTCTTTACATTCCA | PS/MOE 5-10-8 gapmer | miR-1d (Tuschl) |
| 344336 | 1918 | TGGCATTCACCGCGTGCCTTA | PS/MOE | mir-124a (Kosik) |
| 344337 | 1754 | AAAGAGACCGGTTCACTGTGA | PS/MOE | mir-128 (Kosik) |
| 344338 | 1812 | ATGCCCTTTTAACATTGCACTG | PS/MOE | mir-130 (Kosik) |
| 344339 | 1854 | CTCACCGACAGCGTTGAATGTT | PS/MOE | mir-178 (Kosik) |
| 344340 | 1921 | TGTCCGTGGTTCTACCCTGTGGTA | PS/MOE | mir-239* (Kosik) |
| 344341 | 1823 | CACATGGTTAGATCAAGCACAA | PS/MOE | mir-253* (Kosik) |
| 344342 | 1814 | ATGCTTTTTGGGGTAAGGGCTT | PS/MOE | mir-129as/mir-258* (Kosik) |
| 344343 | 1811 | ATGCCCTTTCATCATTGCACTG | PS/MOE | mir-266* (Kosik) |
| 344344 | 1918 | TGGCATTCACCGCGTGCCTTA | PS/MOE 5-10-6 gapmer | mir-124a (Kosik) |
| 344345 | 1754 | AAAGAGACCGGTTCACTGTGA | PS/MOE 5-10-6 gapmer | mir-128 (Kosik) |
| 344346 | 1812 | ATGCCCTTTTAACATTGCACTG | PS/MOE 5-10-7 gapmer | mir-130 (Kosik) |
| 344347 | 1854 | CTCACCGACAGCGTTGAATGTT | PS/MOE 5-10-7 gapmer | mir-178 (Kosik) |
| 344348 | 1921 | TGTCCGTGGTTCTACCCTGTGGTA | PS/MOE 5-10-9 gapmer | mir-239* |

TABLE 65-continued

Oligomeric compounds targeting miRNAs

| ISIS # | SEQ ID NO | sequence | Chemistry | Pri-miRNA |
|---|---|---|---|---|
| 344349 | 1823 | CACATGGTTAGATCAAGCACAA | PS/MOE 5-10-7 gapmer | mir-253* |
| 344350 | 1814 | ATGCTTTTTGGGGTAAGGGCTT | PS/MOE 5-10-7 gapmer | mir-129as/mir-258* |
| 344351 | 1811 | ATGCCCTTTCATCATTGCACTG | PS/MOE 5-10-7 gapmer | mir-266* (Kosik) |
| 344611 | 1785 | ACATTTTTCGTTATTGCTCTTGA | PS/MOE | mir-240* (Kosik) |
| 344612 | 1790 | ACGGAAGGGCAGAGAGGGCCAG | PS/MOE | mir-232* (Kosik) |
| 344613 | 1775 | ACACCAATGCCCTAGGGGATGCG | PS/MOE | mir-227* (Kosik) |
| 344614 | 1834 | CCAGCAGCACCTGGGGCAGT | PS/MOE | mir-226* (Kosik) |
| 344615 | 1900 | TCAACAAAATCACTGATGCTGGA | PS/MOE | mir-244* (Kosik) |
| 344616 | 1800 | AGAGGTCGACCGTGTAATGTGC | PS/MOE | mir-224* (Kosik) |
| 344617 | 1862 | GACGGGTGCGATTTCTGTGTGAGA | PS/MOE | mir-248* (Kosik) |
| 344618 | 1785 | ACATTTTTCGTTATTGCTCTTGA | PS/MOE 5-10-8 gapmer | mir-240* (Kosik) |
| 344619 | 1790 | ACGGAAGGGCAGAGAGGGCCAG | PS/MOE 5-10-7 gapmer | mir-232* (Kosik) |
| 344620 | 1775 | ACACCAATGCCCTAGGGGATGCG | PS/MOE 5-10-8 gapmer | mir-227* (Kosik) |
| 344621 | 1834 | CCAGCAGCACCTGGGGCAGT | PS/MOE 5-10-5 gapmer | mir-226* (Kosik) |
| 344622 | 1900 | TCAACAAAATCACTGATGCTGGA | PS/MOE 5-10-8 gapmer | mir-244* (Kosik) |
| 344623 | 1800 | AGAGGTCGACCGTGTAATGTGC | PS/MOE 5-10-7 gapmer | mir-224* (Kosik) |
| 344624 | 1862 | GACGGGTGCGATTTCTGTGTGAGA | PS/MOE 5-10-9 gapmer | mir-248* (Kosik) |
| 345344 | 291 | CTACCATAGGGTAAAACCACT | PS/MOE 5-10-6 gapmer | mir-140 |
| 345345 | 292 | GCTGCAAACATCCGACTGAAAG | PS/MOE 5-10-7 gapmer | mir-30a |
| 345346 | 293 | ACAACCAGCTAAGACACTGCCA | PS/MOE 5-10-7 gapmer | mir-34 |
| 345347 | 294 | AACACTGATTTCAAATGGTGCTA | PS/MOE 5-10-8 gapmer | mir-29b |
| 345348 | 295 | CGCCAATATTTACGTGCTGCTA | PS/MOE 5-10-7 gapmer | mir-16 |
| 345350 | 297 | AACAAAATCACTAGTCTTCCA | PS/MOE 5-10-6 gapmer | mir-7 |
| 345351 | 299 | AAAGAGACCGGTTCACTGTGA | PS/MOE 5-10-7 gapmer | mir-128a |

TABLE 65-continued

Oligomeric compounds targeting miRNAs

| ISIS # | SEQ ID NO | sequence | Chemistry | Pri-miRNA |
|---|---|---|---|---|
| 345352 | 300 | TCACTTTTGTGACTATGCAA | PS/MOE 5-10-5 gapmer | mir-153 |
| 345353 | 301 | CAGAACTTAGCCACTGTGAA | PS/MOE 5-10-5 gapmer | mir-27b |
| 345354 | 302 | GCAAAAATGTGCTAGTGCCAAA | PS/MOE 5-10-7 gapmer | mir-96 |
| 345355 | 303 | ACTACCTGCACTGTAAGCACTTTG | PS/MOE 5-10-9 gapmer | mir-17as/mir-91 |
| 345356 | 304 | CGCGTACCAAAAGTAATAATG | PS/MOE 5-10-6 gapmer | mir-123/mir-126as |
| 345357 | 305 | GCGACCATGGCTGTAGACTGTTA | PS/MOE 5-10-8 gapmer | mir-132 |
| 345358 | 306 | AATGCCCCTAAAAATCCTTAT | PS/MOE 5-10-6 gapmer | mir-108 |
| 345359 | 308 | AGCACAAACTACTACCTCA | PS/MOE 5-10-4 gapmer | let-7i |
| 345360 | 309 | GGCCGTGACTGGAGACTGTTA | PS/MOE 5-10-6 gapmer | mir-212 |
| 345361 | 311 | AACCACACAACCTACTACCTCA | PS/MOE 5-10-7 gapmer | let-7b |
| 345362 | 312 | ATACATACTTCTTTACATTCCA | PS/MOE 5-10-7 gapmer | mir-1d |
| 345363 | 313 | ACAAACACCATTGTCACACTCCA | PS/MOE 5-10-8 gapmer | mir-122a |
| 345364 | 314 | ACAGTTCTTCAACTGGCAGCTT | PS/MOE 5-10-7 gapmer | mir-22 |
| 345365 | 315 | ACAGGCCGGGACAAGTGGAATA | PS/MOE 5-10-7 gapmer | mir-92 |
| 345366 | 316 | GTAGTGCTTTCTACTTTATG | PS/MOE 5-10-5 gapmer | mir-142 |
| 345367 | 317 | CAGTGAATTCTACCAGTGCCATA | PS/MOE 5-10-8 gapmer | mir-183 |
| 345368 | 318 | CTGCCTGTCTGTGCCTGCTGT | PS/MOE 5-10-6 gapmer | mir-214 |
| 345369 | 320 | GGCTGTCAATTCATAGGTCAG | PS/MOE 5-10-6 gapmer | mir-192 |
| 345370 | 321 | AACTATACAACCTACTACCTCA | PS/MOE 5-10-7 gapmer | let-7a |
| 345371 | 323 | CAGACTCCGGTGGAATGAAGGA | PS/MOE 5-10-7 gapmer | mir-205 |
| 345372 | 324 | TCATAGCCCTGTACAATGCTGCT | PS/MOE 5-10-8 gapmer | mir-103 |
| 345373 | 325 | AGCCTATCCTGGATTACTTGAA | PS/MOE 5-10-7 gapmer | mir-26a |
| 345374 | 326 | CAATGCAACTACAATGCAC | PS/MOE 5-10-4 gapmer | mir-33a |
| 345375 | 327 | CCCAACAACATGAAACTACCTA | PS/MOE 5-10-7 gapmer | mir-196 |

TABLE 65-continued

Oligomeric compounds targeting miRNAs

| ISIS # | SEQ ID NO | sequence | Chemistry | Pri-miRNA |
|---|---|---|---|---|
| 345376 | 328 | TGATAGCCCTGTACAATGCTGCT | PS/MOE 5-10-8 gapmer | mir-107 |
| 345377 | 329 | GCTACCTGCACTGTAAGCACTTTT | PS/MOE 5-10-9 gapmer | mir-106 |
| 345378 | 330 | AACTATACAATCTACTACCTCA | PS/MOE 5-10-7 gapmer | let-7f |
| 345379 | 332 | GCCCTTTTAACATTGCACTG | PS/MOE 5-10-5 gapmer | mir-130a |
| 345380 | 333 | ACATGGTTAGATCAAGCACAA | PS/MOE 5-10-6 gapmer | mir-218 |
| 345381 | 334 | TGGCATTCACCGCGTGCCTTAA | PS/MOE 5-10-7 gapmer | mir-124a |
| 345382 | 335 | TCAACATCAGTCTGATAAGCTA | PS/MOE 5-10-7 gapmer | mir-21 |
| 345383 | 336 | CTAGTACATCATCTATACTGTA | PS/MOE 5-10-7 gapmer | mir-144 |
| 345384 | 337 | GAAACCCAGCAGACAATGTAGCT | PS/MOE 5-10-8 gapmer | mir-221 |
| 345385 | 338 | GAGACCCAGTAGCCAGATGTAGCT | PS/MOE 5-10-9 gapmer | mir-222 |
| 345386 | 339 | CTTCCAGTCGGGATGTTTACA | PS/MOE 5-10-7 gapmer | mir-30d |
| 345387 | 340 | TCAGTTTTGCATGGATTTGCACA | PS/MOE 5-10-8 gapmer | mir-19b |
| 345388 | 341 | GAAAGAGACCGGTTCACTGTGA | PS/MOE 5-10-7 gapmer | mir-128b |
| 345389 | 343 | TAGCTGGTTGAAGGGGACCAA | PS/MOE 5-10-6 gapmer | mir-133b |
| 345390 | 344 | ACTATGCAACCTACTACCTCT | PS/MOE 5-10-6 gapmer | let-7d |
| 345391 | 345 | TGTAAACCATGATGTGCTGCTA | PS/MOE 5-10-7 gapmer | mir-15b |
| 345392 | 347 | GAACAGATAGTCTAAACACTGGG | PS/MOE 5-10-8 gapmer | mir-199b |
| 345393 | 348 | ACTATACAACCTCCTACCTCA | PS/MOE 5-10-6 gapmer | let-7e |
| 345394 | 350 | AGGCATAGGATGACAAAGGGAA | PS/MOE 5-10-7 gapmer | mir-204 |
| 345395 | 351 | AAGGGATTCCTGGGAAAACTGGAC | PS/MOE 5-10-9 gapmer | mir-145 |
| 345396 | 353 | CTACCTGCACTATAAGCACTTTA | PS/MOE 5-10-8 gapmer | mir-20 |
| 345397 | 354 | ACAGCTGGTTGAAGGGGACCAA | PS/MOE 5-10-7 gapmer | mir-133a |
| 345398 | 355 | GATTCACAACACCAGCT | PS/MOE 5-10-2 gapmer | mir-138 |
| 345399 | 357 | TCACAAGTTAGGGTCTCAGGGA | PS/MOE 5-10-7 gapmer | mir-125b |

TABLE 65-continued

Oligomeric compounds targeting miRNAs

| ISIS # | SEQ ID NO | sequence | Chemistry | Pri-miRNA |
|---|---|---|---|---|
| 345400 | 358 | GAACAGGTAGTCTGAACACTGGG | PS/MOE 5-10-8 gapmer | mir-199a |
| 345401 | 359 | AACCCACCGACAGCAATGAATGTT | PS/MOE 5-10-9 gapmer | mir-181b |
| 345402 | 360 | CCATCTTTACCAGACAGTGTT | PS/MOE 5-10-6 gapmer | mir-141 |
| 345403 | 361 | TATCTGCACTAGATGCACCTTA | PS/MOE 5-10-7 gapmer | mir-18 |
| 345404 | 362 | AAAGTGTCAGATACGGTGTGG | PS/MOE 5-10-6 gapmer | mir-220 |
| 345405 | 363 | CTGTTCCTGCTGAACTGAGCCA | PS/MOE 5-10-7 gapmer | mir-24 |
| 345406 | 364 | AGGCGAAGGATGACAAAGGGAA | PS/MOE 5-10-7 gapmer | mir-211 |
| 345407 | 365 | TCAGTTATCACAGTACTGTA | PS/MOE 5-10-5 gapmer | mir-101 |
| 345408 | 366 | GCTGAGTGTAGGATGTTTACA | PS/MOE 5-10-6 gapmer | mir-30b |
| 345409 | 367 | CACAAATTCGGATCTACAGGGTA | PS/MOE 5-10-8 gapmer | mir-10a |
| 345410 | 368 | TCAGTTTTGCATAGATTTGCACA | PS/MOE 5-10-8 gapmer | mir-19a |
| 345411 | 369 | CACAAACCATTATGTGCTGCTA | PS/MOE 5-10-7 gapmer | mir-15a |
| 345412 | 370 | CTACGCGTATTCTTAAGCAATA | PS/MOE 5-10-7 gapmer | mir-137 |
| 345413 | 371 | AGAATTGCGTTTGGACAATCA | PS/MOE 5-10-6 gapmer | mir-219 |
| 345414 | 372 | ACAAAGTTCTGTGATGCACTGA | PS/MOE 5-10-7 gapmer | mir-148b |
| 345415 | 374 | CACAGTTGCCAGCTGAGATTA | PS/MOE 5-10-6 gapmer | mir-216 |
| 345416 | 375 | CACAAGTTCGGATCTACGGGTT | PS/MOE 5-10-7 gapmer | mir-100 |
| 345417 | 376 | CCGGCTGCAACACAAGACACGA | PS/MOE 5-10-7 gapmer | mir-187 |
| 345418 | 377 | CAGCCGCTGTCACACGCACAG | PS/MOE 5-10-6 gapmer | mir-210 |
| 345419 | 378 | GTCTGTCAATTCATAGGTCAT | PS/MOE 5-10-6 gapmer | mir-215 |
| 345420 | 379 | GGGGTATTTGACAAACTGACA | PS/MOE 5-10-6 gapmer | mir-223 |
| 345421 | 380 | GCTGAGAGTGTAGGATGTTTACA | PS/MOE 5-10-8 gapmer | mir-30c |
| 345422 | 381 | AACCTATCCTGAATTACTTGAA | PS/MOE 5-10-7 gapmer | mir-26b |
| 345423 | 382 | CCAAGTTCTGTCATGCACTGA | PS/MOE 5-10-6 gapmer | mir-152 |

TABLE 65-continued

Oligomeric compounds targeting miRNAs

| ISIS # | SEQ ID NO | sequence | Chemistry | Pri-miRNA |
|---|---|---|---|---|
| 345424 | 383 | ATCACATAGGAATAAAAAGCCATA | PS/MOE 5-10-9 gapmer | mir-135 |
| 345425 | 384 | ATCGAATCAGTTCCTGATGCAGTA | PS/MOE 5-10-9 gapmer | mir-217 |
| 345426 | 386 | CAATGCAACAGCAATGCAC | PS/MOE 5-10-4 gapmer | mir-33b |
| 345427 | 387 | TGTGAGTTCTAGCATTGCCAAA | PS/MOE 5-10-7 gapmer | mir-182 |
| 345428 | 388 | ACAAAGTTCTGTAGTGCACTGA | PS/MOE 5-10-7 gapmer | mir-148a |
| 345429 | 389 | GGAAATCCCTGGCAATGTGAT | PS/MOE 5-10-6 gapmer | mir-23a |
| 345430 | 390 | ACTCACCGACAGGTTGAATGTT | PS/MOE 5-10-7 gapmer | mir-181c |
| 345431 | 391 | ACTGTAGGAATATGTTTGATA | PS/MOE 5-10-6 gapmer | hypothetical miRNA-013 |
| 345432 | 392 | ATTAAAAAGTCCTCTTGCCGA | PS/MOE 5-10-6 gapmer | hypothetical miRNA-023 |
| 345433 | 393 | GCTGCCGTATATGTGATGTCA | PS/MOE 5-10-6 gapmer | hypothetical miRNA-030 |
| 345434 | 394 | GGTAGGTGGAATACTATAACA | PS/MOE 5-10-6 gapmer | hypothetical miRNA-033 |
| 345435 | 395 | TAAACATCACTGCAAGTCTTA | PS/MOE 5-10-6 gapmer | hypothetical miRNA-039 |
| 345436 | 396 | TTGTAAGCAGTTTTGTTGACA | PS/MOE 5-10-6 gapmer | hypothetical miRNA-040 |
| 345437 | 397 | TCACAGAGAAAACAACTGGTA | PS/MOE 5-10-6 gapmer | hypothetical miRNA-041 |
| 345438 | 398 | CCTCTCAAAGATTTCCTGTCA | PS/MOE 5-10-6 gapmer | hypothetical miRNA-043 |
| 345439 | 399 | TGTCAGATAAACAGAGTGGAA | PS/MOE 5-10-6 gapmer | hypothetical miRNA-044 |
| 345440 | 400 | GAGAATCAATAGGGCATGCAA | PS/MOE 5-10-6 gapmer | hypothetical miRNA-055 |
| 345441 | 401 | AAGAACATTAAGCATCTGACA | PS/MOE 5-10-6 gapmer | hypothetical miRNA-058 |
| 345442 | 402 | AATCTCTGCAGGCAAATGTGA | PS/MOE 5-10-6 gapmer | hypothetical miRNA-070 |
| 345443 | 403 | AAACCCCTATCACGATTAGCA | PS/MOE 5-10-6 gapmer | hypothetical miRNA-071 |
| 345444 | 404 | GCCCCATTAATATTTTAACCA | PS/MOE 5-10-6 gapmer | hypothetical miRNA-075 |
| 345445 | 405 | CCCAATATCAAACATATCA | PS/MOE 5-10-4 gapmer | hypothetical miRNA-079 |
| 345446 | 406 | TATGATAGCTTCCCCATGTAA | PS/MOE 5-10-6 gapmer | hypothetical miRNA-083 |
| 345447 | 407 | CCTCAATTATTGGAAATCACA | PS/MOE 5-10-6 gapmer | hypothetical miRNA-088 |

TABLE 65-continued

Oligomeric compounds targeting miRNAs

| ISIS # | SEQ ID NO | sequence | Chemistry | Pri-miRNA |
|---|---|---|---|---|
| 345448 | 408 | ATTGATGCGCCATTTGGCCTA | PS/MOE 5-10-6 gapmer | hypothetical miRNA-090 |
| 345449 | 409 | CTGTGACTTCTCTATCTGCCT | PS/MOE 5-10-6 gapmer | hypothetical miRNA-099 |
| 345450 | 410 | AAACTTGTTAATTGACTGTCA | PS/MOE 5-10-6 gapmer | hypothetical miRNA-101 |
| 345451 | 411 | AAAGAAGTATATGCATAGGAA | PS/MOE 5-10-6 gapmer | hypothetical miRNA-105 |
| 345452 | 412 | GATAAAGCCAATAAACTGTCA | PS/MOE 5-10-6 gapmer | hypothetical miRNA-107 |
| 345453 | 413 | TCCGAGTCGGAGGAGGAGGAA | PS/MOE 5-10-6 gapmer | hypothetical miRNA-111 |
| 345454 | 414 | ATCATTACTGGATTGCTGTAA | PS/MOE 5-10-6 gapmer | hypothetical miRNA-120 |
| 345455 | 415 | CAAAAATTATCAGCCAGTTTA | PS/MOE 5-10-6 gapmer | hypothetical miRNA-137 |
| 345456 | 416 | AATCTCATTTTCATACTTGCA | PS/MOE 5-10-6 gapmer | hypothetical miRNA-138 |
| 345457 | 417 | AGAAGGTGGGGAGCAGCGTCA | PS/MOE 5-10-6 gapmer | hypothetical miRNA-142 |
| 345458 | 418 | CAAAATTGCAAGCAAATTGCA | PS/MOE 5-10-6 gapmer | hypothetical miRNA-143 |
| 345459 | 419 | TCCACAAAGCTGAACATGTCT | PS/MOE 5-10-6 gapmer | hypothetical miRNA-144 |
| 345460 | 420 | TATTATCAGCATCTGCTTGCA | PS/MOE 5-10-6 gapmer | hypothetical miRNA-153 |
| 345461 | 421 | AATAACACACATCCACTTTAA | PS/MOE 5-10-6 gapmer | hypothetical miRNA-154 |
| 345462 | 422 | AAGAAGGAAGGAGGGAAAGCA | PS/MOE 5-10-6 gapmer | hypothetical miRNA-156 |
| 345463 | 423 | ATGACTACAAGTTTATGGCCA | PS/MOE 5-10-6 gapmer | hypothetical miRNA-161 |
| 345464 | 424 | CAAAACATAAAAATCCTTGCA | PS/MOE 5-10-6 gapmer | hypothetical miRNA-164 |
| 345465 | 425 | TTACAGGTGCTGCAACTGGAA | PS/MOE 5-10-6 gapmer | hypothetical miRNA-166 |
| 345466 | 426 | AGCAGGTGAAGGCACCTGGCT | PS/MOE 5-10-6 gapmer | hypothetical miRNA-168 |
| 345467 | 427 | TATGAAATGCCAGAGCTGCCA | PS/MOE 5-10-6 gapmer | hypothetical miRNA-169 |
| 345468 | 428 | CCAAGTGTTAGAGCAAGATCA | PS/MOE 5-10-6 gapmer | hypothetical miRNA-170 |
| 345469 | 429 | AACGATAAAACATACTTGTCA | PS/MOE 5-10-6 gapmer | hypothetical miRNA-171 |
| 345470 | 430 | AGTAACTTCTTGCAGTTGGA | PS/MOE 5-10-5 gapmer | hypothetical miRNA-172 |
| 345471 | 431 | AGCCTCCTTCTTCTCGTACTA | PS/MOE 5-10-6 gapmer | hypothetical miRNA-173 |

TABLE 65-continued

Oligomeric compounds targeting miRNAs

| ISIS # | SEQ ID NO | sequence | Chemistry | Pri-miRNA |
|---|---|---|---|---|
| 345472 | 432 | ACCTCAGGTGGTTGAAGGAGA | PS/MOE 5-10-6 gapmer | hypothetical miRNA-175 |
| 345473 | 433 | ATATGTCATATCAAACTCCTA | PS/MOE 5-10-6 gapmer | hypothetical miRNA-176 |
| 345474 | 434 | GTGAGAGTAGCATGTTTGTCT | PS/MOE 5-10-6 gapmer | hypothetical miRNA-177 |
| 345475 | 435 | TGAAGGTTCGGAGATAGGCTA | PS/MOE 5-10-6 gapmer | hypothetical miRNA-178 |
| 345476 | 436 | AATTGGACAAAGTGCCTTTCA | PS/MOE 5-10-6 gapmer | hypothetical miRNA-179 |
| 345477 | 437 | ACCGAACAAAGTCTGACAGGA | PS/MOE 5-10-6 gapmer | hypothetical miRNA-180 |
| 345478 | 438 | AACTACTTCCAGAGCAGGTGA | PS/MOE 5-10-6 gapmer | hypothetical miRNA-181 |
| 345479 | 439 | GTAAGCGCAGCTCCACAGGCT | PS/MOE 5-10-6 gapmer | hypothetical miRNA-183 |
| 345480 | 440 | GAGCTGCTCAGCTGGCCATCA | PS/MOE 5-10-6 gapmer | hypothetical miRNA-185 |
| 345481 | 441 | TACTTTTCATTCGCCTCACCA | PS/MOE 5-10-6 gapmer | hypothetical miRNA-188 |
| 345482 | 236 | TAGCTTATCAGACTGATGTTGA | PS/MOE 5-10-7 gapmer | miR-104 (Mourelatos) |
| 345483 | 1780 | AGAGGAGTCTGAGCATTTGA | PS/MOE 5-10-5 gapmer | miR-105 (Mourelatos) |
| 345484 | 1882 | GGAACTTAGCCACTGTGAA | PS/MOE 5-10-4 gapmer | miR-27 (Mourelatos) |
| 345485 | 848 | CTACCTGCACGAACAGCACTTT | PS/MOE 5-10-7 gapmer | miR-93 (Mourelatos) |
| 345486 | 855 | TGCTCAATAAATACCCGTTGAA | PS/MOE 5-10-7 gapmer | miR-95 (Mourelatos) |
| 345487 | 1821 | CACAAGATCGGATCTACGGGTT | PS/MOE 5-10-7 gapmer | miR-99 (Mourelatos) |
| 345488 | 1903 | TCAGACCGAGACAAGTGCAATG | PS/MOE 5-10-7 gapmer | miR-25 (Tuschl) |
| 345489 | 1853 | CTCAATAGACTGTGAGCTCCTT | PS/MOE 5-10-7 gapmer | miR-28 (Tuschl) |
| 345490 | 1825 | CAGCTATGCCAGCATCTTGCC | PS/MOE 5-10-6 gapmer | miR-31 (Tuschl) |
| 345491 | 1865 | GCAACTTAGTAATGTGCAATA | PS/MOE 5-10-6 gapmer | miR-32 (Tuschl) |
| 345492 | 1897 | TAGGAGAGAGAAAAAGACTGA | PS/MOE 5-10-6 gapmer | miR-14 |
| 345493 | 854 | GGAGTGAAGACACGGAGCCAGA | PS/MOE 5-10-7 gapmer | miR-149 |
| 345494 | 1845 | CGCAAGGTCGGTTCTACGGGTG | PS/MOE 5-10-7 gapmer | miR-99b |
| 345495 | 852 | CACAGGTTAAAGGGTCTCAGGGA | PS/MOE 5-10-8 gapmer | miR-125a |

TABLE 65-continued

Oligomeric compounds targeting miRNAs

| ISIS # | SEQ ID NO | sequence | Chemistry | Pri-miRNA |
|---|---|---|---|---|
| 345496 | 853 | AGCCAAGCTCAGACGGATCCGA | PS/MOE 5-10-7 gapmer | miR-127 |
| 345497 | 1909 | TCCATCATCAAAACAAATGGAGT | PS/MOE 5-10-8 gapmer | miR-136 |
| 345498 | 1843 | CGAAGGCAAGACGGATAACCTA | PS/MOE 5-10-7 gapmer | miR-154 |
| 345499 | 1880 | GCTTCCAGTCGAGGATGTTTACA | PS/MOE 5-10-8 gapmer | miR-30a-s |
| 345500 | 1911 | TCCGTGGTTCTACCCTGTGGTA | PS/MOE 5-10-7 gapmer | miR-140-as |
| 345501 | 1836 | CCATAAAGTAGGAAACACTACA | PS/MOE 5-10-7 gapmer | miR-142-as |
| 345502 | 1761 | AACAGGTAGTCTGAACACTGGG | PS/MOE 5-10-7 gapmer | miR-199-s |
| 345503 | 1762 | AACCAATGTGCAGACTACTGTA | PS/MOE 5-10-7 gapmer | miR-199-as |
| 345504 | 1904 | TCATACAGCTAGATAACCAAAGA | PS/MOE 5-10-8 gapmer | miR-9 |
| 345505 | 1773 | ACAAGTGCCTTCACTGCAGT | PS/MOE 5-10-5 gapmer | miR-17 |
| 345506 | 1871 | GCATTATTACTCACGGTACGA | PS/MOE 5-10-6 gapmer | miR-126a |
| 345507 | 1787 | ACCTAATATATCAAACATATCA | PS/MOE 5-10-7 gapmer | miR-190 |
| 345508 | 1766 | AAGCCCAAAAGGAGAATTCTTTG | PS/MOE 5-10-8 gapmer | miR-186 |
| 345509 | 1839 | CCTATCTCCCCTCTGGACC | PS/MOE 5-10-4 gapmer | miR-198a |
| 345510 | 1806 | AGCTGCTTTTGGGATTCCGTTG | PS/MOE 5-10-7 gapmer | miR-191c |
| 345511 | 760 | CCACACACTTCCTTACATTCCA | PS/MOE 5-10-7 gapmer | miR-206d |
| 345512 | 761 | ATCTGCACTGTCAGCACTTT | PS/MOE 5-10-5 gapmer | miR-94 |
| 345513 | 762 | ACCCTTATCAGTTCTCCGTCCA | PS/MOE 5-10-7 gapmer | miR-184 |
| 345514 | 763 | GCCAATATTTCTGTGCTGCTA | PS/MOE 5-10-6 gapmer | miR-195 |
| 345515 | 764 | CTGGGACTTTGTAGGCCAGTT | PS/MOE 5-10-6 gapmer | miR-193 |
| 345516 | 1861 | GAACTGCCTTTCTCTCCA | PS/MOE 5-10-3 gapmer | miR-185 |
| 345517 | 1786 | ACCCTCCACCATGCAAGGGATG | PS/MOE 5-10-7 gapmer | miR-188 |
| 345518 | 1879 | GCTGGGTGGAGAAGGTGGTGAA | PS/MOE 5-10-7 gapmer | miR-197a |
| 345519 | 1906 | TCCACATGGAGTTGCTGTTACA | PS/MOE 5-10-7 gapmer | miR-194 |

TABLE 65-continued

Oligomeric compounds targeting miRNAs

| ISIS # | SEQ ID NO | sequence | Chemistry | Pri-miRNA |
|---|---|---|---|---|
| 345520 | 1771 | ACAAGCTTTTTGCTCGTCTTAT | PS/MOE 5-10-7 gapmer | miR-208 |
| 345521 | 938 | AGACACGTGCACTGTAGA | PS/MOE 5-10-3 gapmer | miR-139 |
| 345522 | 1887 | GTCATCATTACCAGGCAGTATTA | PS/MOE 5-10-8 gapmer | miR-200b |
| 345523 | 1831 | CATCGTTACCAGACAGTGTTA | PS/MOE 5-10-6 gapmer | miR-200a |
| 345524 | 1827 | CAGCTTTCAAAATGATCTCAC | PS/MOE 5-10-6 gapmer | miR-Bantam |
| 345922 | 1783 | ACAGTGCTTCATCTCA | PO/6MOE-10deoxy hemimer | mir-143 |
| 345923 | 1848 | CTACAGTGCTTCATCTC | PO/6MOE-11deoxy hemimer | mir-143 |
| 345924 | 1876 | GCTACAGTGCTTCATCT | PO/6MOE-11deoxy mir-143 hemimer | |
| 345925 | 1875 | GCTACAGTGCTTCATC | PO/6MOE-10deoxy hemimer | mir-143 |
| 345926 | 1803 | AGCTACAGTGCTTCAT | PO/6MOE-10deoxy hemimer | mir-143 |
| 345927 | 1863 | GAGCTACAGTGCTTCA | PO/6MOE-10deoxy hemimer | mir-143 |
| 345928 | 1916 | TGAGCTACAGTGCTTC | PO/6MOE-10deoxy hemimer | mir-143 |
| 346685 | 1884 | GGCGGAACTTAGCCACTGTGAA | PS/MOE | miR-27a (RFAM-Human) |
| 346686 | 1857 | CTTCAGTTATCACAGTACTGTA | PS/MOE | miR-101 (RFAM-Human) |
| 346687 | 1802 | AGCAAGCCCAGACCGCAAAAAG | PS/MOE | miR-129b (RFAM-Human) |
| 346688 | 1898 | TAGTTGGCAAGTCTAGAACCA | PS/MOE | miR-182* (RFAM-Human) |
| 346689 | 1830 | CATCATTACCAGGCAGTATTAGAG | PS/MOE | miR-200a (RFAM-Human) |
| 346690 | 1792 | ACTGATATCAGCTCAGTAGGCAC | PS/MOE | miR-189 (RFAM-Human) |
| 346691 | 1870 | GCAGAAGCATTTCCACACAC | PS/MOE | miR-147 (RFAM-Human) |
| 346692 | 1889 | TAAACGGAACCACTAGTGACTTG | PS/MOE | miR-224 (RFAM-Human) |
| 346693 | 1838 | CCCTCTGGTCAACCAGTCACA | PS/MOE | miR-134 (RFAM-Human) |
| 346694 | 1763 | AACCCATGGAATTCAGTTCTCA | PS/MOE | miR-146 (RFAM-Human) |
| 346695 | 1824 | CACTGGTACAAGGGTTGGGAGA | PS/MOE | miR-150 (RFAM-Human) |
| 346696 | 1893 | TACCTGCACTATAAGCACTTTA | PS/MOE | mir-20 |

TABLE 65-continued

Oligomeric compounds targeting miRNAs

| ISIS # | SEQ ID NO | sequence | Chemistry | Pri-miRNA |
|---|---|---|---|---|
| 346697 | 1788 | ACCTATCCTGAATTACTTGAA | PS/MOE | mir-26b |
| 346698 | 1793 | ACTGATTTCAAATGGTGCTA | PS/MOE | mir-29b |
| 346699 | 1847 | CGGCTGCAACACAAGACACGA | PS/MOE | miR-187 (RFAM-Human) |
| 346700 | 1844 | CGACCATGGCTGTAGACTGTTA | PS/MOE | miR-132 (RFAM-Human) |
| 346701 | 1901 | TCACATAGGAATAAAAAGCCATA | PS/MOE | miR-135 (RFAM-Human) |
| 346702 | 1893 | TACCTGCACTATAAGCACTTTA | PS/MOE 5-10-7 gapmer | mir-20 |
| 346703 | 1788 | ACCTATCCTGAATTACTTGAA | PS/MOE 5-10-6 gapmer | mir-26b |
| 346704 | 1884 | GGCGGAACTTAGCCACTGTGAA | PS/MOE 5-10-7 gapmer | miR-27a (RFAM-Human) |
| 346705 | 1857 | CTTCAGTTATCACAGTACTGTA | PS/MOE 5-10-7 gapmer | miR-101 (RFAM-Human) |
| 346706 | 1793 | ACTGATTTCAAATGGTGCTA | PS/MOE 5-10-5 gapmer | mir-29b |
| 346707 | 1847 | CGGCTGCAACACAAGACACGA | PS/MOE 5-10-6 gapmer | miR-187 (RFAM-Human) |
| 346708 | 1844 | CGACCATGGCTGTAGACTGTTA | PS/MOE 5-10-7 gapmer | miR-132 (RFAM-Human) |
| 346709 | 1901 | TCACATAGGAATAAAAAGCCATA | PS/MOE 5-10-8 gapmer | miR-135 (RFAM-Human) |
| 346710 | 1802 | AGCAAGCCCAGACCGCAAAAAG | PS/MOE 5-10-7 gapmer | miR-129b (RFAM-Human) |
| 346711 | 1898 | TAGTTGGCAAGTCTAGAACCA | PS/MOE 5-10-6 gapmer | miR-182* (RFAM-Human) |
| 346712 | 1830 | CATCATTACCAGGCAGTATTAGAG | PS/MOE 5-10-9 gapmer | miR-200a (RFAM-Human) |
| 346713 | 1792 | ACTGATATCAGCTCAGTAGGCAC | PS/MOE 5-10-8 gapmer | miR-189 (RFAM-Human) |
| 346714 | 1870 | GCAGAAGCATTTCCACACAC | PS/MOE 5-10-5 gapmer | miR-147 (RFAM-Human) |
| 346715 | 1889 | TAAACGGAACCACTAGTGACTTG | PS/MOE 5-10-8 gapmer | miR-224 (RFAM-Human) |
| 346716 | 1838 | CCCTCTGGTCAACCAGTCACA | PS/MOE 5-10-6 gapmer | miR-134 (RFAM-Human) |
| 346717 | 1763 | AACCCATGGAATTCAGTTCTCA | PS/MOE 5-10-7 gapmer | miR-146 (RFAM-Human) |
| 346718 | 1824 | CACTGGTACAAGGGTTGGGAGA | PS/MOE 5-10-7 gapmer | miR-150 (RFAM-Human) |
| 346905 | 1907 | TCCAGTCAAGGATGTTTACA | PS/MOE | miR-30e (RFAM-M. musculus) |
| 346906 | 1781 | ACAGGATTGAGGGGGGGCCCT | PS/MOE | miR-296 (RFAM-M. musculus) |
| 346907 | 1815 | ATGTATGTGGGACGGTAAACCA | PS/MOE | miR-299 (RFAM-M. musculus) |

TABLE 65-continued

Oligomeric compounds targeting miRNAs

| ISIS # | SEQ ID NO | sequence | Chemistry | Pri-miRNA |
|---|---|---|---|---|
| 346908 | 1881 | GCTTTGACAATACTATTGCACTG | PS/MOE | miR-301 (RFAM-M. musculus) |
| 346909 | 1902 | TCACCAAAACATGGAAGCACTTA | PS/MOE | miR-302 (RFAM-M. musculus) |
| 346910 | 1866 | GCAATCAGCTAACTACACTGCCT | PS/MOE | miR-34a (RFAM-M. musculus) |
| 346911 | 1776 | ACACTGATTTCAAATGGTGCTA | PS/MOE | miR-29b (RFAM-M. musculus) |
| 346912 | 1851 | CTAGTGGTCCTAAACATTTCA | PS/MOE | miR-203 (RFAM-M. musculus) |
| 346913 | 1795 | AGAAAGGCAGCAGGTCGTATAG | PS/MOE | let-7d* (RFAM-M. musculus) |
| 346914 | 1810 | ATCTGCACTGTCAGCACTTTA | PS/MOE | miR-106b (RFAM-M. musculus) |
| 346915 | 1784 | ACATCGTTACCAGACAGTGTTA | PS/MOE | miR-200a (RFAM-M. musculus) |
| 346916 | 1874 | GCGGAACTTAGCCACTGTGAA | PS/MOE | miR-27a (RFAM-M. musculus) |
| 346917 | 1826 | CAGCTATGCCAGCATCTTGCCT | PS/MOE | miR-31 (RFAM-M. musculus) |
| 346918 | 1829 | CAGGCCGGGACAAGTGCAATA | PS/MOE | miR-92 (RFAM-M. musculus) |
| 346919 | 1849 | CTACCTGCACGAACAGCACTTTG | PS/MOE | miR-93 (RFAM-M. musculus) |
| 346920 | 1801 | AGCAAAAATGTGCTAGTGCCAAA | PS/MOE | miR-96 (RFAM-M. musculus) |
| 346921 | 1759 | AACAACCAGCTAAGACACTGCCA | PS/MOE | miR-172 (RFAM-M. musculus) |
| 346922 | 1907 | TCCAGTCAAGGATGTTTACA | PS/MOE 5-10-5 gapmer | miR-30e (RFAM-M. musculus) |
| 346923 | 1781 | ACAGGATTGAGGGGGGGCCCT | PS/MOE 5-10-6 gapmer | miR-296 (RFAM-M. musculus) |
| 346924 | 1815 | ATGTATGTGGGACGGTAAACCA | PS/MOE 5-10-7 gapmer | miR-299 (RFAM-M. musculus) |
| 346925 | 1881 | GCTTTGACAATACTATTGCACTG | PS/MOE 5-10-8 gapmer | miR-301 (RFAM-M. musculus) |
| 346926 | 1902 | TCACCAAAACATGGAAGCACTTA | PS/MOE 5-10-8 gapmer | miR-302 (RFAM-M. musculus) |
| 346927 | 1866 | GCAATCAGCTAACTACACTGCCT | PS/MOE 5-10-8 gapmer | miR-34a (RFAM-M. musculus) |
| 346928 | 1776 | ACACTGATTTCAAATGGTGCTA | PS/MOE 5-10-7 gapmer | miR-29b (RFAM-M. musculus) |
| 346929 | 1851 | CTAGTGGTCCTAAACATTTCA | PS/MOE 5-10-6 gapmer | miR-203 (RFAM-M. musculus) |
| 346930 | 1795 | AGAAAGGCAGCAGGTCGTATAG | PS/MOE 5-10-7 gapmer | let-7d* (RFAM-M. musculus) |
| 346931 | 1810 | ATCTGCACTGTCAGCACTTTA | PS/MOE 5-10-6 gapmer | miR-106b (RFAM-M. musculus) |

TABLE 65-continued

Oligomeric compounds targeting miRNAs

| ISIS # | SEQ ID NO | sequence | Chemistry | Pri-miRNA |
|---|---|---|---|---|
| 346932 | 1784 | ACATCGTTACCAGACAGTGTTA | PS/MOE 5-10-7 gapmer | miR-200a (RFAM-*M. musculus*) |
| 346933 | 1874 | GCGGAACTTAGCCACTGTGAA | PS/MOE 5-10-6 gapmer | miR-27a (RFAM-*M. musculus*) |
| 346934 | 1826 | CAGCTATGCCAGCATCTTGCCT | PS/MOE 5-10-7 gapmer | miR-31 (RFAM-*M. musculus*) |
| 346935 | 1829 | CAGGCCGGGACAAGTGCAATA | PS/MOE 5-10-6 gapmer | miR-92 (RFAM-*M. musculus*) |
| 346936 | 1849 | CTACCTGCACGAACAGCACTTTG | PS/MOE 5-10-8 gapmer | miR-93 (RFAM-*M. musculus*) |
| 346937 | 1801 | AGCAAAAATGTGCTAGTGCCAAA | PS/MOE 5-10-8 gapmer | miR-96 (RFAM-*M. musculus*) |
| 346938 | 1759 | AACAACCAGCTAAGACACTGCCA | PS/MOE 5-10-8 gapmer | miR-172 (RFAM-*M. musculus*) |
| 347385 | 1782 | ACAGTGCTTCATCTC | PO/6MOE-9deoxy hemimer | mir-143 |
| 347386 | 1848 | CTACAGTGCTTCATCTC | PO/6MOE-11deoxy hemimer | mir-143 |
| 347387 | 1876 | GCTACAGTGCTTCATCT | PO/6MOE-11deoxy hemimer | mir-143 |
| 347388 | 1875 | GCTACAGTGCTTCATC | PO/6MOE-10deoxy hemimer | mir-143 |
| 347389 | 1803 | AGCTACAGTGCTTCAT | PO/6MOE-10deoxy hemimer | mir-143 |
| 347390 | 1863 | GAGCTACAGTGCTTCA | PO/6MOE-10deoxy hemimer | mir-143 |
| 347391 | 1916 | TGAGCTACAGTGCTTC | PO/6MOE-10deoxy hemimer | mir-143 |
| 347452 | 1783 | ACAGTGCTTCATCTCA | PO/6MOE-10deoxy hemimer | mir-143 |
| 347453 | 1783 | ACAGTGCTTCATCTCA | PO/6MOE-10deoxy hemimer | mir-143 |
| 348116 | 1922 | TTCGCCCTCTCAACCCAGCTTTT | PS/MOE | miR-320 |
| 348117 | 1860 | GAACCCACAATCCCTGGCTTA | PS/MOE | miR-321-1 |
| 348118 | 1886 | GTAAACCATGATGTGCTGCTA | PS/MOE | miR-15b (Michael et al) |
| 348119 | 1908 | TCCATAAAGTAGGAAACACTACA | PS/MOE | miR-142as (Michael et al) |
| 348120 | 1864 | GAGCTACAGTGCTTCATCTCA | PS/MOE | miR-143 (Michael et al) |
| 348121 | 1883 | GGATTCCTGGGAAAACTGGAC | PS/MOE | miR-145 (Michael et al) |
| 348122 | 1905 | TCATCATTACCAGGCAGTATTA | PS/MOE | miR-200b (Michael et al) |
| 348123 | 1791 | ACTATACAATCTACTACCTCA | PS/MOE | let-7f (Michael et al) |
| 348124 | 1820 | CACAAATTCGGTTCTACAGGGTA | PS/MOE | miR-10b (Michael et al) |

TABLE 65-continued

Oligomeric compounds targeting miRNAs

| ISIS # | SEQ ID NO | sequence | Chemistry | Pri-miRNA |
|---|---|---|---|---|
| 348125 | 1878 | GCTGGATGCAAACCTGCAAAACT | PS/MOE | miR-19b (Michael et al) |
| 348126 | 1873 | GCCTATCCTGGATTACTTGAA | PS/MOE | miR-26a (Michael et al) |
| 348127 | 1869 | GCAGAACTTAGCCACTGTGAA | PS/MOE | miR-27* (Michael et al) |
| 348128 | 1858 | CTTCCAGTCAAGGATGTTTACA | PS/MOE | miR-97 (Michael et al) |
| 348129 | 1855 | CTGGCTGTCAATTCATAGGTCA | PS/MOE | miR-192 (Michael et al) |
| 348130 | 1922 | TTCGCCCTCTCAACCCAGCTTTT | PS/MOE 5-10-8 gapmer | miR-320 |
| 348131 | 1860 | GAACCCACAATCCCTGGCTTA | PS/MOE 5-10-6 gapmer | miR-321-1 |
| 348132 | 1886 | GTAAACCATGATGTGCTGCTA | PS/MOE 5-10-6 gapmer | miR-15b (Michael et al) |
| 348133 | 1908 | TCCATAAAGTAGGAAACACTACA | PS/MOE 5-10-8 gapmer | miR-142as (Michael et al) |
| 348134 | 1864 | GAGGTACAGTGCTTCATCTCA | PS/MOE 5-10-6 gapmer | miR-143 (Michael et al) |
| 348135 | 1883 | GGATTCCTGGGAAAACTGGAC | PS/MOE 5-10-6 gapmer | miR-145 (Michael et al) |
| 348136 | 1905 | TCATCATTACCAGGCAGTATTA | PS/MOE 5-10-7 gapmer | miR-200b (Michael et al) |
| 348137 | 1791 | ACTATACAATCTACTACCTCA | PS/MOE 5-10-6 gapmer | let-7f (Michael et al) |
| 348138 | 1820 | CACAAATTCGGTTCTACAGGGTA | PS/MOE 5-10-8 gapmer | miR-10b (Michael et al) |
| 348139 | 1878 | GCTGGATGCAAACCTGCAAAACT | PS/MOE 5-10-8 gapmer | miR-19b (Michael et al) |
| 348140 | 1873 | GCCTATCCTGGATTACTTGAA | PS/MOE 5-10-6 gapmer | miR-26a (Michael et al) |
| 348141 | 1869 | GCAGAACTTAGCCACTGTGAA | PS/MOE 5-10-6 gapmer | miR-27* (Michael et al) |
| 348142 | 1858 | CTTCCAGTCAAGGATGTTTACA | PS/MOE 5-10-7 gapmer | miR-97 (Michael et al) |
| 348143 | 1855 | CTGGCTGTCAATTCATAGGTCA | PS/MOE 5-10-7 gapmer | miR-192 (Michael et al) |
| 354040 | 1751 | AAACCACACAACCTACTACCTCA | PS/MOE | let-7b-Ruvkun |
| 354041 | 1752 | AAACCATACAACCTACTACCTCA | PS/MOE | let-7c-Ruvkun |
| 354042 | 1764 | AACTATGCAACCTACTACCTCT | PS/MOE | let-7d-Ruvkun |
| 354043 | 1765 | AACTGTACAAACTACTACCTCA | PS/MOE | let-7gL-Ruvkun |
| 354044 | 1760 | AACAGCACAAACTACTACCTCA | PS/MOE | let-7i-Ruvkun |
| 354045 | 1924 | TTGGCATTCACCGCGTGCCTTAA | PS/MOE | mir-124a-Ruvkun |
| 354046 | 1833 | CCAAGCTCAGACGGATCCGA | PS/MOE | mir-127-Ruvkun |
| 354047 | 1896 | TACTTTCGGTTATCTAGCTTTA | PS/MOE | mir-131-Ruvkun |

TABLE 65-continued

Oligomeric compounds targeting miRNAs

| ISIS # | SEQ ID NO | sequence | Chemistry | Pri-miRNA |
|---|---|---|---|---|
| 354048 | 1846 | CGGCCTGATTCACAACACCAGCT | PS/MOE | mir-138-Ruvkun |
| 354049 | 1768 | ACAAACCATTATGTGCTGCTA | PS/MOE | mir-15-Ruvkun |
| 354050 | 1789 | ACGCCAATATTTACGTGCTGCTA | PS/MOE | mir-16-Ruvkun |
| 354051 | 1852 | CTATCTGCACTAGATGCACCTTA | PS/MOE | mir-18-Ruvkun |
| 354052 | 1779 | ACAGCTGCTTTTGGGATTCCGTTG | PS/MOE | mir-191-Ruvkun |
| 354053 | 1891 | TAACCGATTTCAGATGGTGCTA | PS/MOE | mir-29a-Ruvkun |
| 354054 | 1813 | ATGCTTTGACAATACTATTGCACTG | PS/MOE | mir-301-Ruvkun |
| 354055 | 1805 | AGCTGAGTGTAGGATGTTTACA | PS/MOE | mir-30b-Ruvkun |
| 354056 | 1804 | AGCTGAGAGTGTAGGATGTTTACA | PS/MOE | mir-30c-Ruvkun |
| 354057 | 1807 | AGCTTCCAGTCGGGGATGTTTACA | PS/MOE | mir-30d-Ruvkun |
| 354058 | 1835 | CCAGCAGCACCTGGGGCAGTGG | PS/MOE | mir-324-3p-Ruvkun |
| 354059 | 1899 | TATGGCAGACTGTGATTTGTTG | PS/MOE | mir-7-1*-Ruvkun |
| 354060 | 1850 | CTACCTGCACTGTAAGCACTTTG | PS/MOE | mir-91-Ruvkun |
| 354061 | 1822 | CACATAGGAATGAAAAGCCATA | PS/MOE | mir-135b (Ruvkun) |
| 354062 | 1895 | TACTAGACTGTGAGCTCCTCGA | PS/MOE | mir-151* (Ruvkun) |
| 354063 | 1885 | GGCTATAAAGTAACTGAGACGGA | PS/MOE | mir-340 (Ruvkun) |
| 354064 | 1923 | TTCTAGGATAGGCCCAGGGGC | PS/MOE | mir-331 (Ruvkun) |
| 354065 | 1892 | TACATACTTCTTTACATTCCA | PS/MOE | miR-1 (RFAM) |
| 354066 | 1817 | CAATCAGGTAACTACACTGCCT | PS/MOE | miR-34c (RFAM) |
| 354067 | 1837 | CCCGTATCACGATTAGCATTAA | PS/MOE | miR-155 (RFAM) |
| 354068 | 1910 | TGCATCATTACCCGGCAGTATT | PS/MOE | miR-200c (RFAM) |
| 354069 | 1818 | CAATCAGCTAATGACACTGCCT | PS/MOE | miR-34b (RFAM) |
| 354070 | 1753 | AAACCCAGCAGACAATGTAGCT | PS/MOE | mir-221 (RFAM-*M. musculus*) |
| 354071 | 1796 | AGACCCAGTAGCCAGATGTAGCT | PS/MOE | mir-222 (RFAM-*M. musculus*) |
| 354072 | 1917 | TGAGCTCCTGGAGGACAGGGA | PS/MOE | mir-339-1 (RFAM) |
| 354073 | 1925 | TTTAAGTGCTCATAATGCAGT | PS/MOE | miR-20* (human) |
| 354074 | 1926 | TTTTCCCATGCCCTATACCTCT | PS/MOE | miR-202 (human) |
| 354075 | 1856 | CTTCAGCTATCACAGTACTGTA | PS/MOE | miR-101b |
| 354076 | 1894 | TACCTGCACTGTTAGCACTTTG | PS/MOE | miR-106a |
| 354077 | 1772 | ACAAGTGCCCTCACTGCAGT | PS/MOE | miR-17-3p |
| 354078 | 1859 | GAACAGGTAGTCTAAACACTGGG | PS/MOE | miR-199b (mouse) |
| 354079 | 1915 | TCTTCCCATGCGCTATACCTCT | PS/MOE | miR-202 (mouse) |

TABLE 65-continued

Oligomeric compounds targeting miRNAs

| ISIS # | SEQ ID NO | sequence | Chemistry | Pri-miRNA |
|---|---|---|---|---|
| 354080 | 1808 | AGGCAAAGGATGACAAAGGGAA | PS/MOE | miR-211 (mouse) |
| 354081 | 1809 | ATCCAGTCAGTTCCTGATGCAGTA | PS/MOE | miR-217 (mouse) |
| 354082 | 1888 | TAAACGGAACCACTAGTGACTTA | PS/MOE | miR-224 (RFAM mouse) |
| 354083 | 1758 | AACAAAATCACAAGTCTTCCA | PS/MOE | miR-7b |
| 354084 | 1919 | TGTAAGTGCTCGTAATGCAGT | PS/MOE | miR-20* (mouse) |
| 354085 | 1778 | ACACTTACTGGACACCTACTAGG | PS/MOE | mir-325 (human) |
| 354086 | 1777 | ACACTTACTGAGCACCTACTAGG | PS/MOE | mir-325 (mouse) |
| 354087 | 1877 | GCTGGAGGAAGGGCCCAGAGG | PS/MOE | mir-326 (human) |
| 354088 | 1794 | ACTGGAGGAAGGGCCCAGAGG | PS/MOE | mir-326 (mouse) |
| 354089 | 1755 | AAAGAGGTTAACCAGGTGTGTT | PS/MOE | mir-329-1 (human) |
| 354090 | 1750 | AAAAAGGTTAGCTGGGTGTGTT | PS/MOE | mir-329-1 (mouse) |
| 354091 | 1914 | TCTCTGCAGGCCGTGTGCTTTGC | PS/MOE | mir-330 (human) |
| 354092 | 1913 | TCTCTGCAGGCCCTGTGCTTTGC | PS/MOE | mir-330 (mouse) |
| 354093 | 1757 | AAAGGCATCATATAGGAGCTGGA | PS/MOE | mir-337 (human) |
| 354094 | 1756 | AAAGGCATCATATAGGAGCTGAA | PS/MOE | mir-337 (mouse) |
| 354095 | 1872 | GCCCTGGACTAGGAGTCAGCA | PS/MOE | mir-345 (human) |
| 354096 | 1868 | GCACTGGACTAGGGGTCAGCA | PS/MOE | mir-345 (mouse) |
| 354097 | 1799 | AGAGGCAGGCATGCGGGCAGACA | PS/MOE | mir-346 (human) |
| 354098 | 1798 | AGAGGCAGGCACTCGGGCAGACA | PS/MOE | mir-346 (mouse) |
| 354099 | 1840 | CCTCAAGGAGCCTCAGTCTAG | PS/MOE | miR-151 (mouse) |
| 354100 | 1841 | CCTCAAGGAGCCTCAGTCTAGT | PS/MOE | miR-151 (rat) |
| 354101 | 1797 | AGAGGCAGGCACTCAGGCAGACA | PS/MOE | miR-346 (rat) |
| 354102 | 1819 | CAATCAGCTAATTACACTGCCTA | PS/MOE | miR-34b (mouse) |
| 354103 | 1842 | CCTCAAGGAGCTTCAGTCTAGT | PS/MOE | miR-151 (hum) |
| 354104 | 1751 | AAACCACACAACCTACTACCTCA | PS/MOE 5-10-8 gapmer | let-7b-Ruvkun |
| 354105 | 1752 | AAACCATACAACCTACTACCTCA | PS/MOE 5-10-8 gapmer | let-7c-Ruvkun |
| 354106 | 1764 | AACTATGCAACCTACTACCTCT | PS/MOE 5-10-7 gapmer | let-7d-Ruvkun |
| 354107 | 1765 | AACTGTACAAACTACTACCTCA | PS/MOE 5-10-7 gapmer | let-7gL-Ruvkun |
| 354108 | 1760 | AACAGCACAAACTACTACCTCA | PS/MOE 5-10-7 gapmer | let-7i-Ruvkun |
| 354109 | 1924 | TTGGCATTCACCGCGTGCCTTAA | PS/MOE 5-10-8 gapmer | mir-124a-Ruvkun |
| 354110 | 1833 | CCAAGCTCAGACGGATCCGA | PS/MOE 5-10-5 gapmer | mir-127-Ruvkun |

TABLE 65-continued

Oligomeric compounds targeting miRNAs

| ISIS # | SEQ ID NO | sequence | Chemistry | Pri-miRNA |
|---|---|---|---|---|
| 354111 | 1896 | TACTTTCGGTTATCTAGCTTTA | PS/MOE 5-10-7 gapmer | mir-131-Ruvkun |
| 354112 | 1846 | CGGCCTGATTCACAACACCAGCT | PS/MOE 5-10-8 gapmer | mir-138-Ruvkun |
| 354113 | 1768 | ACAAACCATTATGTGCTGCTA | PS/MOE 5-10-6 gapmer | mir-15-Ruvkun |
| 354114 | 1789 | ACGCCAATATTTACGTGCTGCTA | PS/MOE 5-10-8 gapmer | mir-16-Ruvkun |
| 354115 | 1852 | CTATCTGCACTAGATGCACCTTA | PS/MOE 5-10-8 gapmer | mir-18-Ruvkun |
| 354116 | 1779 | ACAGCTGCTTTTGGGATTCCGTTG | PS/MOE 5-10-9 gapmer | mir-191-Ruvkun |
| 354117 | 1891 | TAACCGATTTCAGATGGTGCTA | PS/MOE 5-10-7 gapmer | mir-29a-Ruvkun |
| 354118 | 1813 | ATGCTTTGACAATACTATTGCACTG | PS/MOE 5-10-10 gapmer | mir-301-Ruvkun |
| 354119 | 1805 | AGCTGAGTGTAGGATGTTTACA | PS/MOE 5-10-7 gapmer | mir-30b-Ruvkun |
| 354120 | 1804 | AGCTGAGAGTGTAGGATGTTTACA | PS/MOE 5-10-9 gapmer | mir-30c-Ruvkun |
| 354121 | 1807 | AGCTTCCAGTCGGGGATGTTTACA | PS/MOE 5-10-9 gapmer | mir-30d-Ruvkun |
| 354122 | 1835 | CCAGCAGCACCTGGGGCAGTGG | PS/MOE 5-10-7 gapmer | mir-324-3p-Ruvkun |
| 354123 | 1899 | TATGGCAGACTGTGATTTGTTG | PS/MOE 5-10-7 gapmer | mir-7-1*-Ruvkun |
| 354124 | 1850 | CTACCTGCACTGTAAGCACTTTG | PS/MOE 5-10-8 gapmer | mir-91-Ruvkun |
| 354125 | 1822 | CACATAGGAATGAAAAGCCATA | PS/MOE 5-10-7 gapmer | mir-135b (Ruvkun) |
| 354126 | 1895 | TACTAGACTGTGAGCTCCTCGA | PS/MOE 5-10-7 gapmer | mir-151* (Ruvkun) |
| 354127 | 1885 | GGCTATAAAGTAACTGAGACGGA | PS/MOE 5-10-8 gapmer | mir-340 (Ruvkun) |
| 354128 | 1923 | TTCTAGGATAGGCCCAGGGGC | PS/MOE 5-10-6 gapmer | mir-331 (Ruvkun) |
| 354129 | 1892 | TACATACTTCTTTACATTCCA | PS/MOE 5-10-6 gapmer | miR-1 (RFAM) |
| 354130 | 1817 | CAATCAGCTAACTACACTGCCT | PS/MOE 5-10-7 gapmer | miR-34c (RFAM) |
| 354131 | 1837 | CCCCTATCACGATTAGCATTAA | PS/MOE 5-10-7 gapmer | miR-155 (RFAM) |
| 354132 | 1910 | TCCATCATTACCCGGCAGTATT | PS/MOE 5-10-7 gapmer | miR-200c (RFAM) |
| 354133 | 1818 | CAATCAGCTAATGACACTGCCT | PS/MOE 5-10-7 gapmer | miR-34b (RFAM) |
| 354134 | 1753 | AAACCCAGCAGACAATGTAGCT | PS/MOE 5-10-7 gapmer | mir-221 (RFAM-*M. musculus*) |

TABLE 65-continued

Oligomeric compounds targeting miRNAs

| ISIS # | SEQ ID NO | sequence | Chemistry | Pri-miRNA |
|---|---|---|---|---|
| 354135 | 1796 | AGACCCAGTAGCCAGATGTAGCT | PS/MOE 5-10-8 gapmer | mir-222 (RFAM-*M. musculus*) |
| 354136 | 1917 | TGAGCTCCTGGAGGACAGGGA | PS/MOE 5-10-6 gapmer | mir-339-1 (RFAM) |
| 354137 | 1925 | TTTAAGTGCTCATAATGCAGT | PS/MOE 5-10-6 gapmer | miR-20* (human) |
| 354138 | 1926 | TTTTCCCATGCCCTATACCTCT | PS/MOE 5-10-7 gapmer | miR-202 (human) |
| 354139 | 1856 | CTTCAGCTATCACAGTACTGTA | PS/MOE 5-10-7 gapmer | miR-101b |
| 354140 | 1894 | TACCTGCACTGTTAGCACTTTG | PS/MOE 5-10-7 gapmer | miR-106a |
| 354141 | 1772 | ACAAGTGCCCTCACTGCAGT | PS/MOE 5-10-5 gapmer | miR-17-3p |
| 354142 | 1859 | GAACAGGTAGTCTAAACACTGGG | PS/MOE 5-10-8 gapmer | miR-199b (mouse) |
| 354143 | 1915 | TCTTCCCATGCGCTATACCTCT | PS/MOE 5-10-7 gapmer | miR-202 (mouse) |
| 354144 | 1808 | AGGCAAAGGATGACAAAGGGAA | PS/MOE 5-10-7 gapmer | miR-211 (mouse) |
| 354145 | 1809 | ATCCAGTCAGTTCCTGATGCAGTA | PS/MOE 5-10-9 gapmer | miR-217 (mouse) |
| 354146 | 1888 | TAAACGGAACCACTAGTGACTTA | PS/MOE 5-10-8 gapmer | miR-224 (RFAM mouse) |
| 354147 | 1758 | AACAAAATCACAAGTCTTCCA | PS/MOE 5-10-6 gapmer | miR-7b |
| 354148 | 1919 | TGTAAGTGCTCGTAATGCAGT | PS/MOE 5-10-6 gapmer | miR-20* (mouse) |
| 354149 | 1778 | ACACTTACTGGACACCTACTAGG | PS/MOE 5-10-8 gapmer | mir-325 (human) |
| 354150 | 1777 | ACACTTACTGAGCACCTACTAGG | PS/MOE 5-10-8 gapmer | mir-325 (mouse) |
| 354151 | 1877 | GCTGGAGGAAGGGCCCAGAGG | PS/MOE 5-10-6 gapmer | mir-326 (human) |
| 354152 | 1794 | ACTGGAGGAAGGGCCCAGAGG | PS/MOE 5-10-6 gapmer | mir-326 (mouse) |
| 354153 | 1755 | AAAGAGGTTAACCAGGTGTGTT | PS/MOE 5-10-7 gapmer | mir-329-1 (human) |
| 354154 | 1750 | AAAAAGGTTAGCTGGGTGTGTT | PS/MOE 5-10-7 gapmer | mir-329-1 (mouse) |
| 354155 | 1914 | TCTCTGCAGGCCGTGTGCTTTGC | PS/MOE 5-10-8 gapmer | mir-330 (human) |
| 354156 | 1913 | TCTCTGCAGGCCCTGTGCTTTGC | PS/MOE 5-10-8 gapmer | mir-330 (mouse) |
| 354157 | 1757 | AAAGGCATCATATAGGAGCTGGA | PS/MOE 5-10-8 gapmer | mir-337 (human) |
| 354158 | 1756 | AAAGGCATCATATAGGAGCTGAA | PS/MOE 5-10-8 gapmer | mir-337 (mouse) |

TABLE 65-continued

Oligomeric compounds targeting miRNAs

| ISIS # | SEQ ID NO | sequence | Chemistry | Pri-miRNA |
|---|---|---|---|---|
| 354159 | 1872 | GCCCTGGACTAGGAGTCAGCA | PS/MOE 5-10-6 gapmer | mir-345 (human) |
| 354160 | 1868 | GCACTGGACTAGGGGTCAGCA | PS/MOE 5-10-6 gapmer | mir-345 (mouse) |
| 354161 | 1799 | AGAGGCAGGCATGCGGGCAGACA | PS/MOE 5-10-8 gapmer | mir-346 (human) |
| 354162 | 1798 | AGAGGCAGGCAGTCGGGCAGACA | PS/MOE 5-10-8 gapmer | mir-346 (mouse) |
| 354163 | 1840 | CCTCAAGGAGCCTCAGTCTAG | PS/MOE 5-10-6 gapmer | miR-151 (mouse) |
| 354164 | 1841 | CCTCAAGGAGCCTCAGTCTAGT | PS/MOE 5-10-7 gapmer | miR-151 (rat) |
| 354165 | 1797 | AGAGGCAGGCACTCAGGCAGACA | PS/MOE 5-10-8 gapmer | miR-346 (rat) |
| 354166 | 1819 | CAATCAGCTAATTACACTGCCTA | PS/MOE 5-10-8 gapmer | miR-34b (mouse) |
| 354167 | 1842 | CCTCAAGGAGCTTCAGTCTAGT | PS/MOE 5-10-7 gapmer | miR-151 (human) |

In accordance with the present invention, oligomeric compounds were designed to mimic one or more miRNAs, pre-miRNAs or pri-miRNAs. The oligomeric compounds of the present invention can also be designed to mimic a pri-miRNA, a pre-miRNA or a single- or double-stranded miRNA while incorporating certain chemical modifications that alter one or more properties of the mimic, thus creating a construct with superior properties over the endogenous pri-miRNA, pre-miRNA or miRNA. Oligomeric compounds representing synthesized miRNAs or chemically modified miRNA mimics were given internal numerical identifiers (ISIS Numbers) and are shown in Table 66. These oligomeric compounds can be analyzed for their effect on miRNA, pre-miRNA or pri-miRNA levels or for their effect on downstream target RNA transcripts by quantitative real-time PCR or they can be used in other assays to investigate the role of miRNAs or miRNA downstream targets. In Table 66, "pri-miRNA" indicates the particular pri-miRNA from which the mature miRNA is normally processed when it occurs in the cellular environment. All compounds listed in Table 66 are ribonucleotides. The miRNA mimics consist of phosphorothioate internucleoside linkages, indicated by "PS" in the "Chemistry" column of Table 66, whereas synthesized miRNA oligomeric compounds with phosphodiester internucleoside linkages are indicated by "PO."

TABLE 66 miRNAs and miRNA mimics

| ISIS # | SEQ ID NO | sequence | Linkage chemistry | Pri-miRNA |
|---|---|---|---|---|
| 343092 | 437 | ACCGAACAAAGTCTGACAGGA | PO | hypothetical miRNA 180 |
| 343098 | 1780 | ACAGGAGTCTGAGCATTTGA | PO | miR-105 (Mourelatas) |
| 343099 | 1882 | GGAACTTAGCCACTGTGAA | PO | miR-27 (Mourelatos) |
| 343101 | 855 | TGCTCAATAAATACCCGTTGAA | PO | miR-95 (Mourelatos) |
| 343102 | 1821 | CACAAGATCGGATCTACGGGTT | PO | miR-99 (Mourelatos) |
| 343103 | 1903 | TCAGACCGAGACAAGTGCAATG | PO | miR-25 (Tuschl) |
| 343104 | 1853 | GTCAATAGACTGTGAGCTCCTT | PO | miR-28 (Tuschl) |
| 343105 | 1825 | CAGCTATGCCAGCATCTTGCC | PO | miR-31 (Tuschl) |

TABLE 66-continued miRNAs and miRNA mimics

| ISIS # | SEQ ID NO | sequence | Linkage chemistry | Pri-miRNA |
|---|---|---|---|---|
| 343106 | 1865 | GCAACTTAGTAATGTGCAATA | PO | miR-32 (Tuschl) |
| 343107 | 854 | GGAGTGAAGACACGGAGCCAGA | PO | miR-149 |
| 343108 | 1845 | CGCAAGGTCGGTTCTACGGGTG | PO | miR-99b |
| 343109 | 852 | CACAGGTTAAAGGGTCTCAGGGA | PO | miR-125a |
| 343110 | 853 | AGCCAAGCTCAGACGGATCCGA | PO | miR-127 |
| 343111 | 1909 | TCCATCATCAAAACAAATGGAGT | PO | miR-136 |
| 343112 | 1843 | CGAAGGCAACACGGATAACCTA | PO | miR-154 |
| 343113 | 1880 | GCTTCCAGTCGAGGATGTTTACA | PO | miR-30a-s |
| 343114 | 1911 | TCCGTGGTTCTACCCTGTGGTA | PO | miR-140-as |
| 343115 | 1836 | CCATAAAGTAGGAAACACTACA | PO | miR-142-as |
| 343117 | 1762 | AACCAATGTGCAGACTACTGTA | PO | miR-199-as |
| 343118 | 1904 | TCATACAGCTAGATAACCAAAGA | PO | miR-9 |
| 343119 | 1773 | ACAAGTGCCTTCACTGCAGT | PO | miR-17 |
| 343120 | 1871 | GCATTATTACTCACGGTACGA | PO | miR-126a |
| 343121 | 1787 | ACCTAATATATCAAACATATCA | PO | miR-190 |
| 343122 | 1766 | AAGCCCAAAAGGAGAATTCTTTG | PO | miR-186 |
| 343123 | 1839 | CCTATCTCCCCTCTGGACC | PO | miR-198a |
| 343124 | 1806 | AGCTGCTTTTGGGATTCCGTTG | PO | miR-191c |
| 343125 | 760 | CCACACACTTCCTTACATTCCA | PO | miR-206d |
| 343126 | 761 | ATCTGCACTGTCAGCACTTT | PO | miR-94 |
| 343127 | 762 | ACCCTTATCAGTTCTCCGTCCA | PO | miR-184 |
| 343128 | 763 | GCCAATATTTCTGTGCTGCTA | PO | miR-195 |
| 343129 | 764 | CTGGGACTTTGTAGGCCAGTT | PO | miR-193 |
| 343130 | 1861 | GAACTGCCTTTCTCTCCA | PO | miR-185 |
| 343131 | 1786 | ACCCTCCACCATGCAAGGGATG | PO | miR-188 |
| 343132 | 1879 | GCTGGGTGGAGAAGGTGGTGAA | PO | miR-197a |
| 343133 | 1906 | TCCACATGGAGTTGCTGTTACA | PO | miR-194 |
| 343134 | 1771 | ACAAGCTTTTGCTCGTCTTAT | PO | miR-208 |
| 343135 | 938 | AGACACGTGCACTGTAGA | PO | miR-139 |
| 343136 | 1887 | GTCATCATTACCAGGCAGTATTA | PO | miR-200b |
| 343137 | 1831 | CATCGTTACCAGACAGTGTTA | PO | miR-200a |
| 343138 | 291 | CTACCATAGGGTAAAACCACT | PS | mir-140 |
| 343139 | 292 | GCTGCAAACATCCGACTGAAAG | PS | mir-30a |
| 343140 | 293 | ACAACCAGCTAAGACACTGCCA | PS | mir-34 |
| 343141 | 294 | AACACTGATTTCAAATGGTGCTA | PS | mir-29b |
| 343142 | 295 | CGCCAATATTTACGTGCTGCTA | PS | mir-16 |
| 343143 | 296 | CTAGTGGTCCTAAACATTTCAC | PS | mir-203 |

TABLE 66-continued miRNAs and miRNA mimics

| ISIS # | SEQ ID NO | sequence | Linkage chemistry | Pri-miRNA |
|---|---|---|---|---|
| 343144 | 297 | AACAAAATCACTAGTCTTCCA | PS | mir-7 |
| 343145 | 298 | ACAAATTCGGTTCTACAGGGTA | PS | mir-10b |
| 343146 | 299 | AAAAGAGACCGGTTCACTGTGA | PS | mir-128a |
| 343147 | 300 | TCACTTTTGTGACTATGCAA | PS | mir-153 |
| 343148 | 301 | CAGAACTTAGCCACTGTGAA | PS | mir-27b |
| 343149 | 302 | GCAAAAATGTGCTAGTGCCAAA | PS | mir-96 |
| 343150 | 303 | ACTACCTGCACTGTAAGCACTTTG | PS | mir-17as/mir-91 |
| 343151 | 304 | CGCGTACCAAAAGTAATAATG | PS | mir-123/mir-126as |
| 343152 | 305 | GCGACCATGGCTGTAGACTGTTA | PS | mir-132 |
| 343153 | 306 | AATGCCCCTAAAAATCCTTAT | PS | mir-108 |
| 343154 | 307 | GTGGTAATCCCTGGCAATGTGAT | PS | mir-23b |
| 343155 | 308 | AGCACAAACTACTACCTCA | PS | let-7i |
| 343156 | 309 | GGCCGTGACTGGAGACTGTTA | PS | mir-212 |
| 343157 | 310 | ACTTTCGGTTATCTAGCTTTA | PS | mir-131 |
| 343158 | 311 | AACCACACAACCTACTACCTCA | PS | let-7b |
| 343159 | 312 | ATACATACTTCTTTACATTCCA | PS | mir-1d |
| 343160 | 313 | ACAAACACCATTGTCACACTCCA | PS | mir-122a |
| 343161 | 314 | ACAGTTCTTCAACTGGGAGCTT | PS | mir-22 |
| 343162 | 315 | ACAGGCCGGGACAAGTGCAATA | PS | mir-92 |
| 343163 | 316 | GTAGTGCTTTGTACTTTATG | PS | mir-142 |
| 343164 | 317 | CAGTGAATTCTACCAGTGCCATA | PS | mir-183 |
| 343165 | 318 | CTGCCTGTCTGTGCCTGCTGT | PS | mir-214 |
| 343166 | 319 | TGAGCTACAGTGCTTCATCTCA | PS | mir-143 |
| 343167 | 320 | GGCTGTCAATTCATAGGTCAG | PS | mir-192 |
| 343168 | 321 | AACTATACAACCTACTACCTCA | PS | let-7a |
| 343169 | 322 | ACTCACCGACAGCGTTGAATGTT | PS | mir-181a |
| 343170 | 323 | CAGACTCCGGTGGAATGAAGGA | PS | mir-205 |
| 343171 | 324 | TCATAGCCCTGTACAATGCTGCT | PS | mir-103 |
| 343172 | 325 | AGCCTATCCTGGATTACTTGAA | PS | mir-26a |
| 343173 | 326 | CAATGCAACTACAATGCAC | PS | mir-33a |
| 343174 | 327 | CCCAACAACATGAAACTACCTA | PS | mir-196 |
| 343175 | 328 | TGATAGCCCTGTACAATGCTGCT | PS | mir-107 |
| 343176 | 329 | GCTACCTGCACTGTAAGCACTTTT | PS | mir-106 |
| 343177 | 330 | AACTATACAATCTACTACCTCA | PS | let-7f |
| 343178 | 331 | AACCGATTTCAAATGGTGCTAG | PS | mir-29c |
| 343179 | 332 | GCCCTTTTAACATTGCACTG | PS | mir-130a |

TABLE 66-continued miRNAs and miRNA mimics

| ISIS # | SEQ ID NO | sequence | Linkage chemistry | Pri-miRNA |
|---|---|---|---|---|
| 343180 | 333 | ACATGGTTAGATCAAGCACAA | PS | mir-218 |
| 343181 | 334 | TGGCATTCACCGCGTGCCTTAA | PS | mir-124a |
| 343182 | 335 | TCAACATCAGTCTGATAAGCTA | PS | mir-21 |
| 343183 | 336 | CTAGTACATCATCTATACTGTA | PS | mir-144 |
| 343184 | 337 | GAAACCCAGCAGACAATGTAGCT | PS | mir-221 |
| 343185 | 338 | GAGACCCAGTAGCCAGATGTAGCT | PS | mir-222 |
| 343186 | 339 | CTTCCAGTCGGGGATGTTTACA | PS | mir-30d |
| 343187 | 340 | TCAGTTTTGCATGGATTTGCACA | PS | mir-19b |
| 343188 | 341 | GAAAGAGACCGGTTCACTGTGA | PS | mir-128b |
| 343189 | 342 | GCAAGCCCAGACCGCAAAAAG | PS | mir-129 |
| 343190 | 343 | TAGCTGGTTGAAGGGGACCAA | PS | mir-133b |
| 343191 | 344 | ACTATGCAACCTACTACCTCT | PS | let-7d |
| 343192 | 345 | TGTAAACCATGATGTGCTGCTA | PS | mir-15b |
| 343193 | 346 | AACCGATTTCAGATGGTGCTAG | PS | mir-29a |
| 343194 | 347 | GAACAGATAGTCTAAACACTGGG | PS | mir-199b |
| 343195 | 348 | ACTATACAACCTCCTACCTCA | PS | let-7e |
| 343196 | 349 | AACCATACAACCTACTACCTCA | PS | let-7c |
| 343197 | 350 | AGGCATAGGATGACAAAGGGAA | PS | mir-204 |
| 343198 | 351 | AAGGGATTCCTGGGAAAACTGGAC | PS | mir-145 |
| 343199 | 352 | GGTACAATCAACGGTCGATGGT | PS | mir-213 |
| 343200 | 353 | CTACCTGCACTATAAGCACTTTA | PS | mir-20 |
| 343201 | 354 | ACAGCTGGTTGAAGGGGACCAA | PS | mir-133a |
| 343202 | 355 | GATTCACAACACCAGCT | PS | mir-138 |
| 343203 | 356 | AACAATACAACTTACTACCTCA | PS | mir-98 |
| 343204 | 357 | TCACAAGTTAGGGTCTCAGGGA | PS | mir-125b |
| 343205 | 358 | GAACAGGTAGTCTGAACACTGGG | PS | mir-199a |
| 343206 | 359 | AACCCACCGACAGCAATGAATGTT | PS | mir-181b |
| 343207 | 360 | CCATCTTTACCAGACAGTGTT | PS | mir-141 |
| 343208 | 361 | TATCTGCACTAGATGCACCTTA | PS | mir-18 |
| 343209 | 362 | AAAGTGTCAGATACGGTGTGG | PS | mir-220 |
| 343210 | 363 | CTGTTCCTGCTGAACTGAGCCA | PS | mir-24 |
| 343211 | 364 | AGGCGAAGGATGACAAAGGGAA | PS | mir-211 |
| 343212 | 365 | TCAGTTATCACAGTACTGTA | PS | mir-101 |
| 343213 | 366 | GCTGAGTGTAGGATGTTTACA | PS | mir-30b |
| 343214 | 367 | CACAAATTCGGATCTACAGGGTA | PS | mir-10a |
| 343215 | 368 | TCAGTTTTGCATAGATTTGCACA | PS | mir-19a |
| 343216 | 369 | CACAAACCATTATGTGCTGCTA | PS | mir-15a |

TABLE 66-continued miRNAs and miRNA mimics

| ISIS # | SEQ ID NO | sequence | Linkage chemistry | Pri-miRNA |
|---|---|---|---|---|
| 343217 | 370 | CTACGCGTATTCTTAAGCAATA | PS | mir-137 |
| 343218 | 371 | AGAATTGCGTTTGGACAATCA | PS | mir-219 |
| 343219 | 372 | ACAAAGTTCTGTGATGCACTGA | PS | mir-148b |
| 343220 | 373 | GCCCTTTCATCATTGCACTG | PS | mir-130b |
| 343221 | 374 | CACAGTTGCCAAGCTGAGATTA | PS | mir-216 |
| 343222 | 375 | CACAAGTTCGGATCTACGGGTT | PS | mir-100 |
| 343223 | 376 | CCGGCTGCAACACAAGACACGA | PS | mir-187 |
| 343224 | 377 | CAGCCGCTGTCACACGCACAG | PS | mir-210 |
| 343225 | 378 | GTCTGTCAATTCATAGGTCAT | PS | mir-215 |
| 343226 | 379 | GGGGTATTTGACAAACTGACA | PS | mir-223 |
| 343227 | 380 | GCTGAGAGTGTAGGATGTTTACA | PS | mir-30c |
| 343228 | 381 | AACCTATCCTGAATTACTTGAA | PS | mir-26b |
| 343229 | 382 | CCAAGTTCTGTCATGCACTGA | PS | mir-152 |
| 343230 | 383 | ATCACATAGGAATAAAAAGCCATA | PS | mir-135 |
| 343231 | 384 | ATCCAATCAGTTCCTGATGCAGTA | PS | mir-217 |
| 343232 | 385 | ACTGTACAAACTACTACCTCA | PS | let-7g |
| 343233 | 386 | CAATGCAACAGCAATGCAC | PS | mir-33b |
| 343234 | 387 | TGTGAGTTCTACCATTGCCAAA | PS | mir-182 |
| 343235 | 388 | ACAAAGTTCTGTAGTGCACTGA | PS | mir-148a |
| 343236 | 389 | GGAAATCCCTGGCAATGTGAT | PS | mir-23a |
| 343237 | 390 | ACTCACCGACAGGTTGAATGTT | PS | mir-181c |
| 343238 | 391 | ACTGTAGGAATATGTTTGATA | PS | hypothetical miRNA-013 |
| 343239 | 392 | ATTAAAAAGTCCTCTTGCCCA | PS | hypothetical miRNA-023 |
| 343240 | 393 | GCTGCCGTATATGTGATGTCA | PS | hypothetical miRNA-030 |
| 343241 | 394 | GGTAGGTGGAATACTATAACA | PS | hypothetical miRNA-033 |
| 343242 | 395 | TAAACATCACTGCAAGTCTTA | PS | hypothetical miRNA-039 |
| 343243 | 396 | TTGTAAGCAGTTTTGTTGACA | PS | hypothetical miRNA-040 |
| 343244 | 397 | TCACAGAGAAAACAACTGGTA | PS | hypothetical miRNA-041 |
| 343245 | 398 | CCTCTCAAAGATTTCCTGTCA | PS | hypothetical miRNA-043 |
| 343246 | 399 | TGTCAGATAAACAGAGTGGAA | PS | hypothetical miRNA-044 |
| 343247 | 400 | GAGAATCAATAGGGCATGCAA | PS | hypothetical miRNA-055 |
| 343248 | 401 | AAGAACATTAAGCATCTGACA | PS | hypothetical miRNA-058 |
| 343249 | 402 | AATCTCTGCAGGCAAATGTGA | PS | hypothetical miRNA-070 |
| 343250 | 403 | AAACCCCTATCACGATTAGCA | PS | hypothetical miRNA-071 |
| 343251 | 404 | GCCCCATTAATATTTTAACCA | PS | hypothetical miRNA-075 |
| 343252 | 405 | CCCAATATCAAACATATCA | PS | hypothetical miRNA-079 |

TABLE 66-continued miRNAs and miRNA mimics

| ISIS # | SEQ ID NO | sequence | Linkage chemistry | Pri-miRNA |
|---|---|---|---|---|
| 343253 | 406 | TATGATAGCTTCCCCATGTAA | PS | hypothetical miRNA-083 |
| 343254 | 407 | CCTCAATTATTGGAAATCACA | PS | hypothetical miRNA-088 |
| 343255 | 408 | ATTGATGCGCCATTTGGCCTA | PS | hypothetical miRNA-090 |
| 343256 | 409 | CTGTGACTTCTCTATCTGCCT | PS | hypothetical miRNA-099 |
| 343257 | 410 | AAACTTGTTAATTGACTGTGA | PS | hypothetical miRNA-101 |
| 343258 | 411 | AAAGAAGTATATGCATAGGAA | PS | hypothetical miRNA-105 |
| 343259 | 412 | GATAAAGCCAATAAACTGTCA | PS | hypothetical miRNA-107 |
| 343260 | 413 | TCCGAGTCGGAGGAGGAGGAA | PS | hypothetical miRNA-111 |
| 343261 | 414 | ATCATTACTGGATTGCTGTAA | PS | hypothetical miRNA-120 |
| 343262 | 415 | CAAAAATTATCAGCCAGTTTA | PS | hypothetical miRNA-137 |
| 343263 | 416 | AATCTCATTTTCATACTTGCA | PS | hypothetical miRNA-138 |
| 343264 | 417 | AGAAGGTGGGGAGCAGCGTCA | PS | hypothetical miRNA-142 |
| 343265 | 418 | CAAAATTGCAAGCAAATTGCA | PS | hypothetical miRNA-143 |
| 343266 | 419 | TCCACAAAGCTGAACATGTCT | PS | hypothetical miRNA-144 |
| 343267 | 420 | TATTATCAGCATCTGCTTGCA | PS | hypothetical miRNA-153 |
| 343268 | 421 | AATAACACACATCCACTTTAA | PS | hypothetical miRNA-154 |
| 343269 | 422 | AAGAAGGAAGGAGGGAAAGCA | PS | hypothetical miRNA-156 |
| 343270 | 423 | ATGACTACAAGTTTATGGCCA | PS | hypothetical miRNA-161 |
| 343271 | 424 | CAAAACATAAAAATCCTTGCA | PS | hypothetical miRNA-164 |
| 343272 | 425 | TTACAGGTGCTGCAACTGGAA | PS | hypothetical miRNA-166 |
| 343273 | 426 | AGCAGGTGAAGGCACCTGGCT | PS | hypothetical miRNA-168 |
| 343274 | 427 | TATGAAATGCCAGAGCTGCCA | PS | hypothetical miRNA-169 |
| 343275 | 428 | CCAAGTGTTAGAGCAAGATCA | PS | hypothetical miRNA-170 |
| 343277 | 430 | AGTAACTTCTTGCAGTTGGA | PS | hypothetical miRNA-172 |
| 343278 | 431 | AGCCTCCTTCTTCTCGTACTA | PS | hypothetical miRNA-173 |
| 343279 | 432 | ACCTCAGGTGGTTGAAGGAGA | PS | hypothetical miRNA-175 |
| 343280 | 433 | ATATGTCATATCAAACTCCTA | PS | hypothetical miRNA-176 |
| 343281 | 434 | GTGAGAGTAGCATGTTTGTCT | PS | hypothetical miRNA-177 |
| 343282 | 435 | TGAAGGTTCGGAGATAGGCTA | PS | hypothetical miRNA-178 |
| 343283 | 436 | AATTGGACAAAGTGCCTTTCA | PS | hypothetical miRNA-179 |
| 343284 | 437 | ACCGAACAAAGTCTGACAGGA | PS | hypothetical miRNA-180 |
| 343285 | 438 | AACTACTTCCAGAGCAGGTGA | PS | hypothetical miRNA-181 |
| 343286 | 439 | GTAAGCGCAGCTCCACAGGCT | PS | hypothetical miRNA-183 |
| 343287 | 440 | GAGCTGCTCAGCTGGCCATCA | PS | hypothetical miRNA-185 |
| 343288 | 441 | TACTTTTCATTCCCCTCACCA | PS | hypothetical miRNA-188 |
| 343289 | 236 | TAGCTTATCAGACTGATGTTGA | PS | miR-104 (Mourelatos) |
| 343290 | 1780 | ACAGGAGTCTGAGCATTTGA | PS | miR-105 (Mourelatos) |

TABLE 66-continued miRNAs and miRNA mimics

| ISIS # | SEQ ID NO | sequence | Linkage chemistry | Pri-miRNA |
|---|---|---|---|---|
| 343291 | 1882 | GGAACTTAGCCACTGTGAA | PS | miR-27 (Mourelatos) |
| 343292 | 848 | CTACCTGCACGAACAGCACTTT | PS | miR-93 (Mourelatos) |
| 343293 | 855 | TGCTCAATAAATACCCGTTGAA | PS | miR-95 (Mourelatos) |
| 343294 | 1821 | CACAAGATCGGATCTACGGGTT | PS | miR-99 (Mourelatos) |
| 343295 | 1903 | TCAGACCGAGACAAGTGCAATG | PS | miR-25 (Tuschl) |
| 343296 | 1853 | CTCAATAGACTGTGAGGTCCTT | PS | miR-28 (Tuschl) |
| 343297 | 1825 | CAGCTATGCCAGCATCTTGCC | PS | miR-31 (Tuschl) |
| 343298 | 1865 | GCAACTTAGTAATGTGCAATA | PS | miR-32 (Tuschl) |
| 343299 | 854 | GGAGTGAAGACACGGAGCCAGA | PS | miR-149 |
| 343300 | 1845 | CGCAAGGTCGGTTCTACGGGTG | PS | miR-99b |
| 343301 | 852 | CACAGGTTAAAGGGTCTCAGGGA | PS | miR-125a |
| 343302 | 853 | AGCCAAGCTCAGACGGATCCGA | PS | miR-127 |
| 343303 | 1909 | TCCATCATCAAAACAAATGGAGT | PS | miR-136 |
| 343304 | 1843 | CGAAGGCAACACGGATAACCTA | PS | miR-154 |
| 343305 | 1880 | GCTTCCAGTCGAGGATGTTTACA | PS | miR-30a-s |
| 343306 | 1911 | TCCGTGGTTCTACCCTGTGGTA | PS | miR-140-as |
| 343307 | 1836 | CCATAAAGTAGGAAACACTACA | PS | miR-142-as |
| 343308 | 1761 | AACAGGTAGTCTGAACACTGGG | PS | miR-199-s |
| 343309 | 1762 | AACCAATGTGCAGACTACTGTA | PS | miR-199-as |
| 343310 | 1904 | TCATACAGCTAGATAACCAAAGA | PS | miR-9 |
| 343311 | 1773 | ACAAGTGCCTTCACTGCAGT | PS | miR-17 |
| 343312 | 1871 | GCATTATTACTCACGGTACGA | PS | miR-126a |
| 343313 | 1787 | ACCTAATATATCAAACATATCA | PS | miR-190 |
| 343314 | 1766 | AAGCCCAAAAGGAGAATTCTTTG | PS | miR-186 |
| 343315 | 1839 | CCTATCTCCCCTCTGGACC | PS | miR-198a |
| 343316 | 1806 | AGCTGCTTTTGGGATTCCGTTG | PS | miR-191c |
| 343317 | 760 | CCACACACTTCCTTACATTCCA | PS | miR-206d |
| 343318 | 761 | ATCTGCACTGTCAGCACTTT | PS | miR-94 |
| 343319 | 762 | ACCCTTATCAGTTCTCCGTCCA | PS | miR-184 |
| 343320 | 763 | GCCAATATTTCTGTGCTGCTA | PS | miR-195 |
| 343321 | 764 | CTGGGACTTTGTAGGCCAGTT | PS | miR-193 |
| 343322 | 1861 | GAACTGCCTTTCTCTCCA | PS | miR-185 |
| 343323 | 1786 | ACCCTCCACCATGCAAGGGATG | PS | miR-188 |
| 343324 | 1879 | GCTGGGTGGAGAAGGTGGTGAA | PS | miR-197a |
| 343325 | 1906 | TCCACATGGAGTTGCTGTTACA | PS | miR-194 |
| 343326 | 1771 | ACAAGCTTTTGCTCGTCTTAT | PS | miR-208 |

TABLE 66-continued miRNAs and miRNA mimics

| ISIS # | SEQ ID NO | sequence | Linkage chemistry | Pri-miRNA |
|---|---|---|---|---|
| 343327 | 938 | AGACACGTGCACTGTAGA | PS | miR-139 |
| 343328 | 1887 | GTCATCATTACCAGGCAGTATTA | PS | miR-200b |
| 343329 | 1831 | CATCGTTACCAGACAGTGTTA | PS | miR-200a |
| 344290 | 1774 | ACACAAATTCGGTTCTACAGGG | PO | miR-10b (Tuschl) |
| 344292 | 1867 | GCACGAACAGCACTTTG | PO | miR-93 (Tuschl) |
| 344293 | 1770 | ACAAGATCGGATCTACGCGT | PO | miR-99a (Tuschl) |
| 344297 | 1912 | TCTAGTGGTCCTAAACATTTCA | PO | miR-203 (Tuschl) |
| 344298 | 1828 | CAGGCATAGGATGACAAAGGGAA | PO | miR-204 (Tuschl) |
| 344299 | 1767 | AATACATACTTCTTTACATTCCA | PO | miR-1d (Tuschl) |
| 344300 | 1769 | ACAAATTCGGATCTACAGGGTA | PS | miR-10 (Tuschl) |
| 344301 | 1774 | ACACAAATTCGGTTCTACAGGG | PS | miR-10b (Tuschl) |
| 344302 | 1890 | TAACCGATTTCAAATGGTGCTA | PS | miR-29c (Tuschl) |
| 344303 | 1867 | GCACGAACAGCACTTTG | PS | miR-93 (Tuschl) |
| 344304 | 1770 | ACAAGATCGGATCTACGGGT | PS | miR-99a (Tuschl) |
| 344305 | 1816 | CAAACACCATTGTCACACTCCA | PS | miR-122a, b (Tuschl) |
| 344306 | 1920 | TGTCAATTCATAGGTCAG | PS | miR-192 (Tuschl) |
| 344307 | 1832 | CCAACAACATGAAACTACCTA | PS | miR-196 (Tuschl) |
| 344308 | 1912 | TCTAGTGGTCCTAAACATTTCA | PS | miR-203 (Tuschl) |
| 344309 | 1828 | CAGGCATAGGATGACAAAGGGAA | PS | miR-204 (Tuschl) |
| 344310 | 1767 | AATACATACTTCTTTACATTCCA | PS | miR-1d (Tuschl) |
| 344354 | 1812 | ATGCCGTTTTAACATTGCACTG | PO | mir-130 (Kosik) |
| 344356 | 1921 | TGTCCGTGGTTCTACCCTGTGGTA | PO | mir-239* (Kosik) |
| 344358 | 1814 | ATGCTTTTTGGGGTAAGGGCTT | PO | mir-129as/mir-258* (Kosik) |
| 344359 | 1811 | ATGCCCTTTCATCATTGCACTG | PO | mir-266* (Kosik) |
| 344360 | 1918 | TGGCATTCACCGCGTGCCTTA | PS | mir-124a (Kosik) |
| 344361 | 1754 | AAAGAGACCGGTTCACTGTGA | PS | mir-128 (Kosik) |
| 344362 | 1812 | ATGCCCTTTTAACATTGCACTG | PS | mir-130 (Kosik) |
| 344363 | 1854 | CTCACCGACAGCGTTGAATGTT | PS | mir-178 (Kosik) |
| 344364 | 1921 | TGTCCGTGGTTCTACCCTGTGGTA | PS | mir-239* (Kosik) |
| 344365 | 1823 | CACATGGTTAGATCAAGCACAA | PS | mir-253* (Kosik) |
| 344366 | 1814 | ATGCTTTTTGGGGTAAGGGCTT | PS | mir-129as/mir-258* (Kosik) |
| 344367 | 1811 | ATGCCCTTTCATCATTGCACTG | PS | mir-266* (Kosik) |
| 344625 | 1785 | ACATTTTTCGTTATTGCTCTTGA | PO | mir-240* (Kosik) |
| 344626 | 1790 | ACGGAAGGGCAGAGAGGGCCAG | PO | mir-232* (Kosik) |
| 344627 | 1775 | ACACCAATGCCCTAGGGGATGCG | PO | mir-227* (Kosik) |
| 344628 | 1834 | CCAGCAGCACCTGGGGCAGT | PO | mir-226* (Kosik) |

TABLE 66-continued miRNAs and miRNA mimics

| ISIS # | SEQ ID NO | sequence | Linkage chemistry | Pri-miRNA |
|---|---|---|---|---|
| 344629 | 1900 | TCAACAAAATCACTGATGCTGGA | PO | mir-244* (Kosik) |
| 344630 | 1800 | AGAGGTCGACCGTGTAATGTGC | PO | mir-224* (Kosik) |
| 34463i | 1862 | GACGGGTGCGATTTCTGTGTGAGA | PO | mir-248* (Kosik) |
| 344632 | 1785 | ACATTTTTCGTTATTGCTCTTGA | PS | mir-240* (Kosik) |
| 344633 | 1790 | ACGGAAGGGCAGAGAGGGCCAG | PS | mir-232* (Kosik) |
| 344634 | 1775 | ACACCAATGCCCTAGGGGATGCG | PS | mir-227* (Kosik) |
| 344635 | 1834 | CCAGCAGCACCTGGGGCAGT | PS | mir-226* (Kosik) |
| 344636 | 1900 | TCAACAAAATCACTGATGCTGGA | PS | mir-244* (Kosik) |
| 344637 | 1800 | AGAGGTCGACCGTGTAATGTGC | PS | mir-224* (Kosik) |
| 344638 | 1862 | GACGGGTGCGATTTCTGTGTGAGA | PS | mir-248* (Kosik) |
| 345527 | 1827 | CAGCTTTCAAAATGATCTCAC | PO | miR-Bantam |
| 345529 | 1897 | TAGGAGAGAGAAAAAGACTGA | PS | miR-14 |
| 345531 | 1827 | CAGCTTTCAAAATGATCTCAC | PS | miR-Bantam |
| 345708 | 1897 | TAGGAGAGAGAAAAAGACTGA | PO | miR-14 |
| 346721 | 1884 | GGCGGAACTTAGCCACTGTGAA | PO | miR-27a (RFAM-Human) |
| 346722 | 1857 | CTTCAGTTATCACAGTACTGTA | PO | miR-101 (RFAM-Human) |
| 346727 | 1802 | AGCAAGCCCAGACCGCAAAAAG | PO | miR-129b (RFAM-Human) |
| 346728 | 1898 | TAGTTGGCAAGTCTAGAACCA | PO | miR-182* (RFAM-Human) |
| 346729 | 1830 | CATCATTACCAGGCAGTATTAGAG | PO | miR-200a (RFAM-Human) |
| 346730 | 1792 | ACTGATATCAGCTCAGTAGGCAC | PO | miR-189 (RFAM-Human) |
| 346731 | 1870 | GCAGAAGCATTTCCACACAC | PO | miR-147 (RFAM-Human) |
| 346732 | 1889 | TAAACGGAACCACTAGTGACTTG | PO | miR-224 (RFAM-Human) |
| 346733 | 1838 | CCCTCTGGTCAACCAGTCACA | PO | miR-134 (RFAM-Human) |
| 346734 | 1763 | AACCCATGGAATTCAGTTCTCA | PO | miR-146 (RFAM-Human) |
| 346735 | 1824 | CACTGGTACAAGGGTTGGGAGA | PO | miR-150 (RFAM-Human) |
| 346736 | 1893 | TACCTGCACTATAAGCACTTTA | PS | mir-20 |
| 346737 | 1788 | ACCTATCCTGAATTACTTGAA | PS | mir-26b |
| 346738 | 1884 | GGCGGAACTTAGCCACTGTGAA | PS | miR-27a (RFAM-Human) |
| 346739 | 1857 | CTTCAGTTATCACAGTACTGTA | PS | miR-101 (RFAM-Human) |
| 346740 | 1793 | ACTGATTTCAAATGGTGCTA | PS | mir-29b |
| 346741 | 1847 | CGGCTGCAACACAAGACACGA | PS | miR-187 (RFAM-Human) |
| 346742 | 1844 | CGACCATGGCTGTAGACTGTTA | PS | miR-132 (RFAM-Human) |
| 346743 | 1901 | TCACATAGGAATAAAAAGCCATA | PS | miR-135 (RFAM-Human) |
| 346744 | 1802 | AGCAAGCCCAGACCGCAAAAAG | PS | miR-129b (RFAM-Human) |
| 346745 | 1898 | TAGTTGGCAAGTCTAGAACCA | PS | miR-182* (RFAM-Human) |
| 346746 | 1830 | CATCATTACCAGGCAGTATTAGAG | PS | miR-200a (RFAM-Human) |

TABLE 66-continued miRNAs and miRNA mimics

| ISIS # | SEQ ID NO | sequence | Linkage chemistry | Pri-miRNA |
|---|---|---|---|---|
| 346747 | 1792 | ACTGATATCAGCTCAGTAGGCAC | PS | miR-189 (RFAM-Human) |
| 346748 | 1870 | GCAGAAGCATTTCCACACAC | PS | miR-147 (RFAM-Human) |
| 346749 | 1889 | TAAACGGAACCACTAGTGACTTG | PS | miR-224 (RFAM-Human) |
| 346750 | 1838 | CCCTCTGGTCAACCAGTCACA | PS | miR-134 (RFAM-Human) |
| 346751 | 1763 | AACCCATGGAATTCAGTTCTCA | PS | miR-146 (RFAM-Human) |
| 346752 | 1824 | CACTGGTACAAGGGTTGGGAGA | PS | miR-150 (RFAM-Human) |
| 346939 | 1907 | TCCAGTCAAGGATGTTTACA | PO | miR-30e (RFAM-M. musculus) |
| 346940 | 1781 | ACAGGATTGAGGGGGGGCCCT | PO | miR-296 (RFAM-M. musculus) |
| 346941 | 1815 | ATGTATGTGGGACGGTAAACCA | PO | miR-299 (RFAM-M. musculus) |
| 346942 | 1881 | GCTTTGACAATACTATTGCACTG | PO | miR-301 (RFAM-M. musculus) |
| 346943 | 1902 | TCACCAAAACATGGAAGCACTTA | PO | miR-302 (RFAM-M. musculus) |
| 346944 | 1866 | GCAATCAGCTAACTACACTGCCT | PO | miR-34a (RFAM-M. musculus) |
| 346945 | 1776 | ACACTGATTTCAAATGGTGCTA | PO | miR-29b (RFAM-M. musculus) |
| 346947 | 1795 | AGAAAGGCAGCAGGTCGTATAG | PO | let-7d* (RFAM-M. musculus) |
| 346948 | 1810 | ATCTGCACTGTCAGCACTTTA | PO | miR-106b (RFAM-M. musculus) |
| 346949 | 1784 | ACATCGTTACCAGACAGTGTTA | PO | miR-200a (RFAM-M. musculus) |
| 346950 | 1874 | GCGGAACTTAGCCACTGTGAA | PO | miR-27a (RFAM-M. musculus) |
| 346951 | 1826 | CAGCTATGCCAGCATCTTGCCT | PO | miR-31 (RFAM-M. musculus) |
| 346954 | 1801 | AGCAAAAATGTGCTAGTGCCAAA | PO | miR-96 (RFAM-M. musculus) |
| 346955 | 1759 | AACAACCAGCTAAGACACTGCCA | PO | miR-172 (RFAM-M. musculus) |
| 346956 | 1907 | TCCAGTCAAGGATGTTTACA | PS | miR-30e (RFAM-M. musculus) |
| 346957 | 1781 | ACAGGATTGAGGGGGGGCCCT | PS | miR-296 (RFAM-M. musculus) |
| 346958 | 1815 | ATGTATGTGGGACGGTAAACCA | PS | miR-299 (RFAM-M. musculus) |
| 346959 | 1881 | GCTTTGACAATACTATTGCACTG | PS | miR-301 (RFAM-M. musculus) |
| 346960 | 1902 | TCACCAAAACATGGAAGCACTTA | PS | miR-302 (RFAM-M. musculus) |
| 346961 | 1866 | GCAATCAGCTAACTACACTGCCT | PS | miR-34a (RFAM-M. musculus) |

TABLE 66-continued miRNAs and miRNA mimics

| ISIS # | SEQ ID NO | sequence | Linkage chemistry | Pri-miRNA |
|---|---|---|---|---|
| 346962 | 1776 | ACACTGATTTCAAATGGTGCTA | PS | miR-29b (RFAM-M. musculus) |
| 346963 | 1851 | CTAGTGGTCCTAAACATTTCA | PS | miR-203 (RFAM-M. musculus) |
| 346964 | 1795 | AGAAAGGCAGCAGGTCGTATAG | PS | let-7d* (RFAM-M. musculus) |
| 346965 | 1810 | ATCTGCACTGTCAGCACTTTA | PS | miR-106b (RFAM-M. musculus) |
| 346966 | 1784 | ACATCGTTACCAGACAGTGTTA | PS | miR-200a (RFAM-M. musculus) |
| 346967 | 1874 | GCGGAACTTAGCCACTGTGAA | PS | miR-27a (RFAM-M. musculus) |
| 346968 | 1826 | CAGCTATGCCAGCATCTTGCCT | PS | miR-31 (RFAM-M. musculus) |
| 346969 | 1829 | CAGGCCGGGACAAGTGCAATA | PS | miR-92 (RFAM-M. musculus) |
| 346970 | 1849 | CTACCTGCACGAACAGCACTTTG | PS | miR-93 (RFAM-M. musculus) |
| 346971 | 1801 | AGCAAAAATGTGCTAGTGCCAAA | PS | miR-96 (RFAM-M. musculus) |
| 346972 | 1759 | AACAACCAGCTAAGACACTGCCA | PS | miR-172 (RFAM-M. musculus) |
| 348169 | 1922 | TTCGCCCTCTCAACCCAGCTTTT | PO | miR-320 |
| 348170 | 1860 | GAACCCACAATCCCTGGCTTA | PO | miR-321-1 |
| 348172 | 1908 | TCCATAAAGTAGGAAACACTACA | PO | miR-142as (Michael et al) |
| 348175 | 1905 | TCATCATTACCAGGCAGTATTA | PO | miR-200b (Michael et al) |
| 348177 | 1820 | CACAAATTCGGTTCTACAGGGTA | PO | miR-10b (Michael et al) |
| 348178 | 1878 | GCTGGATGCAAACCTGCAAAACT | PO | miR-19b (Michael et al) |
| 348180 | 1869 | GCAGAACTTAGCCACTGTGAA | PO | miR-27* (Michael et al) |
| 348181 | 1858 | CTTCCAGTCAAGGATGTTTACA | PO | miR-97 (Michael et al) |
| 348182 | 1855 | CTGGCTGTCAATTCATAGGTCA | PO | miR-192 (Michael et al) |
| 348183 | 1922 | TTCGCCCTCTCAACCCAGCTTTT | PS | miR-320 |
| 348184 | 1860 | GAACCCACAATCCCTGGCTTA | PS | miR-321-1 |
| 348185 | 1886 | GTAAACCATGATGTGCTGCTA | PS | miR-15b (Michael et al) |
| 348186 | 1908 | TCCATAAAGTAGGAAACACTACA | PS | miR-142as (Michael et al) |
| 348188 | 1883 | GGATTCCTGGGAAAACTGGAC | PS | miR-145 (Michael et al) |
| 348189 | 1905 | TCATCATTACCAGGCAGTATTA | PS | miR-200b (Michael et al) |
| 348190 | 1791 | ACTATACAATCTACTACCTCA | PS | let-7f (Michael et al) |
| 348191 | 1820 | CACAAATTCGGTTCTACAGGGTA | PS | miR-10b (Michael et al) |
| 348192 | 1878 | GCTGGATGCAAACCTGCAAAACT | PS | miR-19b (Michael et al) |
| 348193 | 1873 | GCCTATCCTGGATTACTTGAA | PS | miR-26a (Michael et al) |
| 348194 | 1869 | GCAGAACTTAGCCACTGTGAA | PS | miR-27* (Michael et al) |

TABLE 66-continued miRNAs and miRNA mimics

| ISIS # | SEQ ID NO | sequence | Linkage chemistry | Pri-miRNA |
|---|---|---|---|---|
| 348195 | 1858 | CTTCCAGTCAAGGATGTTTACA | PS | miR-97 (Michael et al) |
| 348196 | 1855 | CTGGCTGTCAATTCATAGGTCA | PS | miR-192 (Michael et al) |
| 354168 | 1751 | AAACCACACAACCTACTACCTCA | PS | let-7b-Ruvkun |
| 354169 | 1752 | AAACCATACAACCTACTACCTCA | PS | let-7c-Ruvkun |
| 354170 | 1764 | AACTATGCAACCTACTACCTCT | PS | let-7d-Ruvkun |
| 354171 | 1765 | AACTGTACAAACTACTACCTCA | PS | let-7gL-Ruvkun |
| 354172 | 1760 | AACAGCACAAACTACTACCTCA | PS | let-7i-Ruvkun |
| 354173 | 1924 | TTGGCATTCACCGCGTGCCTTAA | PS | mir-124a-Ruvkun |
| 354174 | 1833 | CCAAGCTCAGACGGATCCGA | PS | mir-127-Ruvkun |
| 354175 | 1896 | TACTTTCGGTTATCTAGCTTTA | PS | mir-131-Ruvkun |
| 354176 | 1846 | CGGCCTGATTCACAACACCAGCT | PS | mir-138-Ruvkun |
| 354177 | 1768 | ACAAACCATTATGTGCTGCTA | PS | mir-15-Ruvkun |
| 354178 | 1789 | ACGCCAATATTTACGTGCTGCTA | PS | mir-16-Ruvkun |
| 354179 | 1852 | CTATCTGCACTAGATGCACCTTA | PS | mir-18-Ruvkun |
| 354180 | 1779 | ACAGCTGCTTTTGGGATTCCGTTG | PS | mir-191-Ruvkun |
| 354181 | 1891 | TAACCGATTTCAGATGGTGCTA | PS | mir-29a-Ruvkun |
| 354182 | 1813 | ATGCTTTGACAATACTATTGCACTG | PS | mir-301-Ruvkun |
| 354183 | 1805 | AGCTGAGTGTAGGATGTTTACA | PS | mir-30b-Ruvkun |
| 354184 | 1804 | AGCTGAGAGTGTAGGATGTTTACA | PS | mir-30c-Ruvkun |
| 354185 | 1807 | AGCTTCCAGTCGGGGATGTTTACA | PS | mir-30d-Ruvkun |
| 354186 | 1835 | CCAGCAGCACCTGGGGCAGTGG | PS | mir-324-3p-Ruvkun |
| 354187 | 1899 | TATGGCAGACTGTGATTTGTTG | PS | mir-7-1*Ruvkun |
| 354188 | 1850 | CTACCTGCACTGTAAGCACTTTG | PS | mir-91-Ruvkun |
| 354189 | 1822 | CACATAGGAATGAAAAGCCATA | PS | mir-135b (Ruvkun) |
| 354190 | 1895 | TACTAGACTGTGAGCTCCTCGA | PS | mir-151* (Ruvkun) |
| 354191 | 1885 | GGCTATAAAGTAAGTGAGACGGA | PS | mir-340 (Ruvkun) |
| 354192 | 1923 | TTCTAGGATAGGCCCAGGGGC | PS | mir-331 (Ruvkun) |
| 354193 | 1892 | TACATACTTCTTTACATTCCA | PS | miR-1 (RFAM) |
| 354194 | 1817 | CAATCAGCTAACTACACTGCCT | PS | miR-34c (RFAM) |
| 354195 | 1837 | CCCCTATCACGATTAGCATTAA | PS | miR-155 (RFAM) |
| 354196 | 1910 | TCCATCATTACCCGGCAGTATT | PS | miR-200c (RFAM) |
| 354197 | 1818 | CAATCAGCTAATGACACTGCCT | PS | miR-34b (RFAM) |
| 354198 | 1753 | AAACCCAGCAGACAATGTAGCT | PS | mir-221 (RFAM-*M. musculus*) |
| 354199 | 1796 | AGACCCAGTAGCCAGATGTAGCT | PS | mir-222 (RFAM-*M. musculus*) |
| 354200 | 1917 | TGAGCTCCTGGAGGACAGGGA | PS | mir-339-1 (RFAM) |

TABLE 66-continued miRNAs and miRNA mimics

| ISIS # | SEQ ID NO | sequence | Linkage chemistry | Pri-miRNA |
|---|---|---|---|---|
| 354201 | 1925 | TTTAAGTGCTCATAATGCAGT | PS | miR-20* (human) |
| 354202 | 1926 | TTTTCCCATGCCCTATACCTCT | PS | miR-202 (human) |
| 354203 | 1856 | CTTCAGCTATCACAGTACTGTA | PS | miR-101b |
| 354204 | 1894 | TACCTGCACTGTTAGCACTTTG | PS | miR-106a |
| 354205 | 1772 | ACAAGTGCCCTCACTGCAGT | PS | miR-17-3p |
| 354206 | 1859 | GAACAGGTAGTCTAAACACTGGG | PS | miR-199b (mouse) |
| 354207 | 1915 | TCTTCCCATGCGCTATACCTCT | PS | miR-202 (mouse) |
| 354208 | 1808 | AGGCAAAGGATGACAAAGGGAA | PS | miR-211 (mouse) |
| 354209 | 1809 | ATCCAGTCAGTTCCTGATGCAGTA | PS | miR-217 (mouse) |
| 354210 | 1888 | TAAACGGAACCACTAGTGACTTA | PS | miR-224 (RFAM-mouse) |
| 354211 | 1758 | AACAAAATCACAAGTCTTCCA | PS | miR-7b |
| 354212 | 1919 | TGTAAGTGCTCGTAATGCAGT | PS | miR-20* (mouse) |
| 354213 | 1778 | ACACTTACTGGACACCTACTAGG | PS | mir-325 (human) |
| 354214 | 1777 | ACACTTACTGAGCACCTACTAGG | PS | mir-325 (mouse) |
| 354215 | 1877 | GCTGGAGGAAGGGCCCAGAGG | PS | mir-326 (human) |
| 354216 | 1794 | ACTGGAGGAAGGGCCCAGAGG | PS | mir-326 (mouse) |
| 354217 | 1755 | AAAGAGGTTAACCAGGTGTGTT | PS | mir-329-1 (human) |
| 354218 | 1750 | AAAAAGGTTAGCTGGGTGTGTT | PS | mir-329-1 (mouse) |
| 354219 | 1914 | TCTCTGCAGGCCGTGTGCTTTGC | PS | mir-330 (human) |
| 354220 | 1913 | TCTCTGCAGGCCCTGTGCTTTGC | PS | mir-330 (mouse) |
| 354221 | 1757 | AAAGGCATCATATAGGAGCTGGA | PS | mir-337 (human) |
| 354222 | 1756 | AAAGGCATCATATAGGAGCTGAA | PS | mir-337 (mouse) |
| 354223 | 1872 | GCCCTGGACTAGGAGTCAGCA | PS | mir-345 (human) |
| 354224 | 1868 | GCACTGGACTAGGGGTCAGCA | PS | mir-345 (mouse) |
| 354225 | 1799 | AGAGGCAGGCATGCGGGCAGACA | PS | mir-346 (human) |
| 354226 | 1798 | AGAGGCAGGCACTCGGGCAGACA | PS | mir-346 (mouse) |
| 354228 | 1841 | CCTCAAGGAGCCTCAGTCTAGT | PS | miR-151 (rat) |
| 354229 | 1797 | AGAGGCAGGCACTCAGGCAGACA | PS | mir-346 (rat) |
| 354230 | 1819 | CAATCAGCTAATTACACTGCCTA | PS | miR-34b (mouse) |
| 354231 | 1842 | CCTCAAGGAGGTTCAGTCTAGT | PS | miR-151 (human) |
| 354232 | 1751 | AAACCACACAACCTACTACCTCA | PO | let-7b-Ruvkun |
| 354234 | 1764 | AACTATGCAACCTACTACCTCT | PO | let-7d-Ruvkun |
| 354235 | 1765 | AACTGTACAAACTACTACCTCA | PO | let-7gL-Ruvkun |
| 354236 | 1760 | AACAGCACAAACTACTACCTCA | PO | let-7i-Ruvkun |
| 354238 | 1833 | CCAAGCTCAGACGGATCCGA | PO | mir-127-Ruvkun |
| 354239 | 1896 | TACTTTCGGTTATCTAGCTTTA | PO | mir-131-Ruvkun |
| 354240 | 1846 | CGGCCTGATTCACAACACCAGCT | PO | mir-138-Ruvkun |

TABLE 66-continued miRNAs and miRNA mimics

| ISIS # | SEQ ID NO | sequence | Linkage chemistry | Pri-miRNA |
|---|---|---|---|---|
| 354242 | 1789 | ACGCCAATATTTACGTGCTGCTA | PO | mir-16-Ruvkun |
| 354243 | 1852 | CTATCTGCACTAGATGCACCTTA | PO | mir-18-Ruvkun |
| 354244 | 1779 | ACAGCTGCTTTTGGGATTCCGTTG | PO | mir-191-Ruvkun |
| 354245 | 1891 | TAACCGATTTCAGATGGTGCTA | PO | mir-29a-Ruvkun |
| 354246 | 1813 | ATGCTTTGACAATACTATTGCACTG | PO | mir-301-Ruvkun |
| 354248 | 1804 | AGCTGAGAGTGTAGGATGTTTACA | PO | mir-30c-Ruvkun |
| 354250 | 1835 | CCAGCAGCACCTGGGGCAGTGG | PO | mir-324-3p-Ruvkun |
| 354251 | 1899 | TATGGCAGACTGTGATTTGTTG | PO | mir-7-1*-Ruvkun |
| 354253 | 1822 | CACATAGGAATGAAAAGCCATA | PO | mir-135b (Ruvkun) |
| 354254 | 1895 | TACTAGACTGTGAGCTCCTCGA | PO | mir-151* (Ruvkun) |
| 354255 | 1885 | GGCTATAAAGTAACTGAGACGGA | PO | mir-340 (Ruvkun) |
| 354256 | 1923 | TTCTAGGATAGGCCCAGGGGC | PO | mir-331 (Ruvkun) |
| 354258 | 1817 | CAATCAGCTAACTACACTGCCT | PO | miR-34c (RFAM) |
| 354259 | 1837 | CCCCTATCACGATTAGCATTAA | PO | miR-155 (RFAM) |
| 354260 | 1910 | TCCATCATTACCCGGCAGTATT | PO | miR-200c (RFAM) |
| 354261 | 1818 | CAATCAGCTAATGACACTGCCT | PO | miR-34b (RFAM) |
| 354264 | 1917 | TGAGCTCCTGGAGGACAGGGA | PO | mir-339-1 (RFAM) |
| 354265 | 1925 | TTTAAGTGCTCATAATGCAGT | PO | miR-20* (human) |
| 354266 | 1926 | TTTTCCCATGCCCTATACCTCT | PO | miR-202 (human) |
| 354267 | 1856 | CTTCAGCTATCACAGTACTGTA | PO | miR-101b |
| 354268 | 1894 | TACCTGCACTGTTAGCACTTTG | PO | miR-106a |
| 354269 | 1772 | ACAAGTGCCCTCACTGCAGT | PO | miR-17-3p |
| 354270 | 1859 | GAACAGGTAGTCTAAACACTGGG | PO | miR-199b (mouse) |
| 354271 | 1915 | TCTTCCCATGCGCTATACCTCT | PO | miR-202 (mouse) |
| 354272 | 1808 | AGGCAAAGGATGACAAAGGGAA | PO | miR-211 (mouse) |
| 354273 | 1809 | ATCCAGTCAGTTCCTGATGCAGTA | PO | miR-217 (mouse) |
| 354274 | 1888 | TAAACGGAACCACTAGTGACTTA | PO | miR-224 (RFAM-mouse) |
| 354275 | 1758 | AACAAAATCACAAGTCTTCCA | PO | miR-7b |
| 354276 | 1919 | TGTAAGTGCTCGTAATGCAGT | PO | miR-20* (mouse) |
| 354277 | 1778 | ACACTTACTGGACACCTACTAGG | PO | mir-325 (human) |
| 354278 | 1777 | ACACTTACTGAGCACCTACTAGG | PO | mir-325 (mouse) |
| 354279 | 1877 | GCTGGAGGAAGGGCCCAGAGG | PO | mir-326 (human) |
| 354280 | 1794 | ACTGGAGGAAGGGCCCAGAGG | PO | mir-326 (mouse) |
| 354281 | 1755 | AAAGAGGTTAACCAGGTGTGTT | PO | mir-329-1 (human) |
| 354282 | 1750 | AAAAAGGTTAGCTGGGTGTGTT | PO | mir-329-1 (mouse) |
| 354283 | 4914 | TCTCTGCAGGCCGTGTGCTTTGC | PO | mir-330 (human) |

TABLE 66-continued miRNAs and miRNA mimics

| ISIS # | SEQ ID NO | sequence | Linkage chemistry | Pri-miRNA |
|---|---|---|---|---|
| 354284 | 1913 | TCTCTGCAGGCCCTGTGCTTTGC | PO | mir-330 (mouse) |
| 354285 | 1757 | AAAGGCATCATATAGGAGCTGGA | PO | mir-337 (human) |
| 354286 | 1756 | AAAGGCATCATATAGGAGCTGAA | PO | mir-337 (mouse) |
| 354287 | 1872 | GCCCTGGACTAGGAGTCAGCA | PO | mir-345 (human) |
| 354288 | 1868 | GCACTGGACTAGGGGTCAGCA | PO | mir-345 (mouse) |
| 354289 | 1799 | AGAGGCAGGCATGCGGGCAGACA | PO | mir-346 (human) |
| 354290 | 1798 | AGAGGCAGGCACTCGGGCAGACA | PO | mir-346 (mouse) |
| 354292 | 1841 | CCTCAAGGAGCCTCAGTCTAGT | PO | miR-151 (rat) |
| 354293 | 1797 | AGAGGCAGGCACTCAGGCAGACA | PO | miR-346 (rat) |
| 354294 | 1819 | CAATCAGCTAATTACACTGCCTA | PO | miR-34b (mouse) |
| 354295 | 1842 | CCTCAAGGAGCTTCAGTCTAGT | PO | miR-151 (human) |

It is also understood that, although many of the oligomeric compounds listed in Tables 64-66 have been designed to target or mimic a particular miRNA from humans, for example, that oligomeric compound may also target or mimic other miRNAs from mammals, such as those from rodent species, for example. It is also understood that these miRNAs and mimics can serve as the basis for several variations of nucleic acid oligomeric compounds, including compounds with chemical modifications such as uniform or chimeric 2'-MOE oligomeric compounds, as well as LNAs and PNAs; such oligomeric compounds are also within the scope of the invention. One such non-limiting example is ISIS Number 351104 (CTAGTGGTCCTAAACATTTCAC; SEQ ID NO: 296), which is a PNA oligomeric compound targeted to the human mir-203 miRNA.

Example 35

Targeting miRNAs in Introns and Exons

By mapping the coding sequences of miRNAs onto genomic contigs (which sequence information is available from public databases, such as GenBank and Locus Link), and identifying loci at which other reported gene coding sequences also co-map, it was observed that miRNAs can be encoded within the exons or introns of other genes. The oligomeric compounds of the present invention can be designed to target introns and exons of these genes. For example, the oligomeric compounds of the present invention can be designed to target introns or exons of the genes listed in Table 67. More specifically, these oligomeric compounds can target the miRNAs encoded within the exons or introns of these genes listed in Table 67.

TABLE 67

Oligomeric compounds targeting miRNAs found within introns or exons

| ISIS # | SEQ ID NO: | Locus containing miRNA | Sequence of locus | Locus SEQ ID NO |
|---|---|---|---|---|
| 327873 | 291 | Ubiquitin protein ligase WWP2 containing mir-140 | GAATTCGCGGCCGCGTCGACCGCTTCTGTGGCC ACGGCAGATGAAACAGAAAGGCTAAAGAGGGCT GGAGTCAGGGGACTTCTCTTCCACCAGCTTCAC GGTGATGATATGGCATCTGCCAGCTCTAGCCGG GCAGGAGTGGCCCTGCCTTTTGAGAAGTCTCAG CTCACTTTGAAAGTGGTGTCCGCAAAGCCCAAG GTGCATAATCGTCAACCTGAATTAACTCCTAC GTGGAGGTGGCGGTGGATGGACTC | 1928 |
| 327874 | 292 | hypothetical protein FLJ13189 | ATGCGAGGCTGGGGCCGGTTGCCTACCGGCCGC TTCTGGCCGAGGCAGTCCAGACTTTTCCCCCGG CGGTGCCCGCTCCAAGACAGCATCTGTCAACGC TCCTCTTCTCCCCTCCTCCTCCTGCCGGGCCGG GCTCCGCCGGCTGCGGCCGAGAGGACGCGGGAC CCGGCGCGGTGAGCCCATCAGCTGTCAGGCGAG | 1929 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | CGGCGAAGCGGGTGGAGGGCGGCGAGAGACACA CAAAGAACGCGGTGGGCGGCGGCG | |
| 327877 | 295 | deleted in lymphocytic leukemia, 2 containing mir-16-1 and mir-15a-1 | GATGCCTGATCTCATGAATCTAGCGGGAGAGAC AGGATAACCTGTCCGAGAGTATAGCGCCACTTA TGACTCCGCCGGAAAAATTACTTTAAAAATCGC CAAAAATTACTTGGAGCAAAGGGCAGTCCGGCG GCGTTCGCCAAGGTGGCGCAGTCGGTTTTGACC TGTAGCAGAGAACCAATTCTGGAGAACAGCCTC ACTTCTTTGATTGAATACTTACATAATGCATTG GAACATGACATGAGATTAAGGTTT | 1930 |
| 327877 | 295 | SMC4 (structural maintenance of chromosomes 4, yeast)-like 1 containing mir-16-3 and mir-15b | TTTTTATTTTTTTCGAGTGAAGGACCCGGAGCC GAAACACCGGTAGAGCGGGGAGGTGGGTACTAC ACAACCGTCTCCAGCCTTGGTCTGAGTGGACTG TCCTGCAGCGACCATGCCCCGTAAAGGCACCCA GCCCTCCACTGCCCGGCGCAGAGAGGAAGGGCC GCCGCCGCCGTCCCCTGACGGCGCCAGCAGCGA CGCGGAGCCTGAGCCGCCGTCCGGCCGCACGGA GAGCCCAGCCACCGCCGCAGAGAC | 1931 |
| 327879 | 297 | heterogeneous nuclear ribonucleoprotein K containing mir-7-1 | AGGGCGCTCCAGGCGACACGATTGCAGACGCCA TTATCCTCTGTTTCTCTGCTGCACCGACCTCGA CGTCTTGCCTGTGTCCCAGTTGTTCGCGGCCTA TAGGCTACTGCAGCACTGGGGTGTCAGTTGTTG GTCCGACCCAGAACGCTTCAGTTGTGCTCTGCA AGGATATATAATAACTGATTGGTGTGCCCGTTT AATAAAAGAATATGGAAACTGAACAGCCAGAAG AAACCTTCCCTAACACTGAAACCA | 1932 |
| 327879 | 297 | pituitary gland specific factor 1a containing mir-7-3 | ACCTGCATCTGCCAACAAGACTGGAAGCAGGTG AGGCACACAGAGGGGGAGGCGCGCAGCTGCGTG GGAGGAGGGGTGGTCTGAGGGACGTGGGATGCC GGGAATGAGGCTGGTTTGCAGGTTGGCGCATGG ACATTTTCCCAGAAAGGGACAGAGACGGCGAAG TTTGACGGTCTGGAAAGCAGAGACCAGCAGGGC TGACTGCTTGGGAGCAGCAAATATCCGGACAGC GCCTCTCGGGAGGTCCGAGAAGAG | 1933 |
| 327881 | 299 | R3H domain (binds single-stranded nucleic acids) containing containing mir-128a | TGCCGCTGGAGCCGGTGTCCGGGCTGGTGATGG GGTTAATTCCCTTTCGTAAGACTCTTACTTGCA CCCACCCAGCCCCGCCGTCGCCCCGCCGCGCCG CGCTCCAACCGCCTCCTCCTCCTCAGTAACGCG GGCCACGGAAAGGTATGATATATTTGATCCAAG ACAGTCCATTCCAGTCCGGGAATCTACAGTGGT GACAAGGACATGGGACTCCTCCTGCCAGATTAC AGATGGTTCACTACAGTTGACATC | 1934 |
| 327882 | 300 | protein tyrosine phosphatase, receptor type, N polypeptide 2 containing mir-153-2 | CAGGCGGCGGGGATGGGGCCGCCGCTCCCGCTG CTGCTGCTGCTACTGCTGCTGCTGCCGCCACGC GTCCTGCGTGCCGCCCCTTCGTCCGTCCCCCGC GGCCGGCAGCTCCCGGGGCGTCTGGGCTGCCTG CTCGAGGAGGGCCTCTGCGGAGCGTCCGAGGCC TGTGTGAACGATGGAGTGTTTGGAAGGTGCCAG AAGGTTCCGGCAATGGACTTTTACCGCTACGAG GTGTCGCCCGTGGCCCTGCAGCGC | 1935 |
| 327882 | 300 | protein tyrosine phosphatase, receptor type, N containing mir-153-1 | CAGCCCCTCTGGCAGGCTGCCGCCAGCGTCGCT GCGGCTCCGGCCCGGGAGCGAGCGCCCGGAGCT CGGAAAGATGCGGCGCCCGCGGCGGCCTGGGGG TCTCGGGGGATCCGGGGGTCTCCGGCTGCTCCT CTGCCTCCTGCTGCTGAGCAGCCGCCCGGGGGG CTGCAGCGCCGTTAGTGCCCACGGCTGTCTATT TGACCGCAGGCTCTGCTCTCACCTGGAAGTGTG TATTCAGGATGGCTTGTTTGGGCA | 1936 |
| 327883 | 301 | chromosome 9 ORF3 containing mir-23b, mir-24-2 and mir-27b | CTCCAGGCACACGCAGCACACACAGCACATGCA CCACACGTAGCACACACACTGCATGCAGCACAC ACACACCAGAGGACGCACCACACAGAGCACGCA CAGCACACACCACACAGCGCACGCACCACACAG AGCACACGCGGCACACACAGCACACACAGCGCA CGCACCACGCAGAGCACACACGGCACATGCAGG | 1937 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | ATACACACCAAACAGGGCATGCACCACACAGAG CACACGCGGCACACGCAGCACACA | |
| 327892 | 310 | Transcriptional activator of the c-fos promoter containing mir-131-1/miR-9 | CTCCTCAGAGAAGCCTGGAGCTGGGCATCCAAG AAGAAGCAGCCTCATTTGTTTTCTGGTGTCATC GTAGGTGGCCACCTATGGCTTTTGGGAATGTAA AAAGGGCAGCTCTCTGGCATGTTCCTGACTGAG GATCTCATAACATTTAACTTGAGGAACTTCCTC CTTTTCCAGCTTTGGGAGTCAAGCTTCTCACCT GGGGCGGGTGGGTTCTGCACCACCCTCCCACCC TCCTTCCTCCGTGTGGACGATAGA | 1938 |
| 327896 | 314 | hypothetical protein MGC14376 containing mir-22 | GGCACGAGGTAGAGAAGCAGGGGATAGACTCAT AGGCTGCAACAAAGGTGACTCTGTCCCTGGACA CTGCCTCCGTACTTTCTCCTTGCTTCACTGGCC ACAGCATCTCCCTCCAGCCCTCGCTATGTGCCT CTGCCATCTTCACCCATCATGGAGCAGAGGTGA GGAGAGGCAGCCTGGGAATATGGAGACCAGTGA AGGACCAGGCCTGGAGAGCACAGGGTCCTACCT GGGCATCCAGCAGAGGAGCCCCTA | 1939 |
| 327906 | 324 | hypothetical protein FLJ11729 containing mir-103-2 | ATGCTGGGGAGGGGCTGGCGCCTCGACGGCA GCTGCGGAACTAGGCCGAGGGACAAAGGCTAAG TTTTTCCATGGTTTGGACTGGATATCGGTGGAA CTCTGGTCAAGCTGGTATATTTTGAACCCAAAG ACATCACTGCTGAAGAAGAAGAGGAAGAAGTGG AAAGTCTTAAAAGCATTCGGAAGTACCTGACCT CCAATGTGGCTTATGGGTCTACAGGCATTCGGG ACGTGCACCTCGAGCTGAAGGACC | 1940 |
| 327906 | 324 | hypothetical protein FLJ12899 containing mir-103-1 | AGTGCGGCGGCGCCGCCTCTGCTCTCAGTGCCC CGGATCGGAGGCCGTCCATCGCCCCTCGGGCGG ACGCCATGAAGATCAAAGATGCCAAGAAACCCT CTTTCCCATGGTTTGGCATGGACATTGGGGGAA CTCTAGTAAAGCTCTCGTACTTTGAACCTATTG ATATCACAGCAGAGGAAGAGCAAGAAGAAGTTG AGAGTTTAAAAAGTATTCGGAAATATTTGACTT CTAACGTGGCATATGGATCCACCG | 1941 |
| 327907 | 325 | conserved gene amplified in osteosarcoma containing miR-26a-2 | CTATGATGGCCAGCCACCGCTGAGAGCACGAAG CTGCTGCTGGCTGGCATTTTTCTCTAGCGTTGT GGTGCCACCTNCCCTTATNACCTTGGGACAAGA AGGGAAGGTGGCCATTGTCTTTCTCTTTGGAAT CATAAAGTGGAACAGAGTCCCCAGAACTCATGT GGCCATTTCCGCCAGCATCACTCCCCGGTGCCT ATGGGGTCCCGGTGTACCTAAAGGGAGAAGGAC CCCATGTGCTAGCCAGAAATATAC | 1942 |
| 327907 | 325 | HYA22 protein containing miR-26a-1 | CCCCTCACCCCACTCAACTGCCCCGGGCCCCCG CGCGCGCGGCCGCCCCTCCACTCACCCTGTGTC GGCCCCGCTCCCCTCTCCCCCACCAGGCGAGCA GGCGAGCGGGCAGAGCCCGCGGCGGAGGTCGGC GCGGCTCCGGGGTTCATGGTGACGAGGCGGCGG CCGCTCGAGCCCAGCGGCGGCGGGCGGCGGGAG CTGGGGCGCGGGCCCGGGCCGCCTCTCCCAGAG CGCGGGGCCGGGCGGCGGGCGCGC | 1943 |
| 327908 | 326 | Sterol regulatory element binding transcription factor 2 containing mir-33a | CCGTCGGTGAGGCGGTGCCGGGCGGGGGTTGTC GGGTGTCATGGGCGGTGGCGACGGCACCGGCCC CGCGTCTCCCTGAGCGGGACGGCAGGGGGGGCT TCTGCGCTGAGCCGGGCGATGGACGACAGCGGC GAGCTGGGTGGTCTGGAGACCATGGAGACCGTC ACGGAGCTGGGCGACGAGCTGACCCTGGGAGAC ATCGACGAGATGCTGCAATTTGTCAGTAATCAA GTGGGAGAGTTCCCTGACTTGTTT | 1944 |
| 327910 | 328 | pantothenate kinase containing mir-107 | GCACAATCTAAAGCTTGTATATATAATGGTAGT TTGTAAAGTGTACCTTCCCCACAGGACGCTGTG GGATGTAAATTTGTAGGTCGAGTTTACAGCTGG TTTTTCTTGACTGAAGCTCATTCAACTGGTTAC TTCTTTGTGGGTGTCTTTAATGAAGCTTATAAA TGGCAAAAAGCAAACATTCCCATGGTTTGGCAT | 1945 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | GGACATCGGTGGAACGCTGGTTAAATTGGTGTA TTTCGAGCCGAAGGATATTACAGC | |
| 327912 | 330 | upstream regulatory element binding protein 1 containing mir-98 and let-7f-2 | ATGTTTAACCCTATGTATGCCTTGTTCCGTACC TCACCTGGTGATCGAGTCACCTACACCATCAAT CCATCTTCCCACTGCAACGCCAACCACCTCAGC TACTTCAAGTTTGTCGGACGCATTGTGGCCAAA GCTGTATATGACAACCGTCTTCTGGAGTGCTAC TTTACTCGATCCTTTTACAAACACATCTTGGGC AAGTCAGTCAGATATACAGATATGGAGAGTGAA GATTACCACTTCTACCAAGGTCTG | 1946 |
| 327915 | 333 | slit (Drosophila) homolog 3 containing mir-218-2 | CAACAGCATCAGCATGCTGACCAATTACACCTT CAGTAACATGTCTCACCTCTCCACTCTGATCCT GAGCTACAACCGGCTGAGGTGCATCCCCGTCCA CGCCTTCAACGGGCTGCGGTCCCTGCGAGTGCT AACCCTCCATGGCAATGACATTTCCAGCGTTCC TGAAGGCTCCTTCAACGACCTCACATCTCTTTC CCATCTGGCGCTGGGAACCAACCCACTCCACTG TGACTGCAGTCTTCGGTGGCTGTC | 1947 |
| 327915 | 333 | slit (Drosophila) homolog 2 containing mir-218-1 | CAGAGCAGGGTGGAGAGGGCGGTGGGAGGCGTG TGCCTGAGTGGGCTCTACTGCCTTGTTCCATAT TATTTTGTGCACATTTTCCCTGGCACTCTGGGT TGCTAGCCCCGCCGGGCACTGGGCCTCAGACAC TGCGCGGTTCCCTCGGAGCAGCAAGCTAAAGAA AGCCCCCAGTGCCGGCGAGGAAGGAGGCGGCGG GGAAAGATGCGCGGCGTTGGCTGGCAGATGCTG TCCCTGTCGCTGGGGTTAGTGCTG | 1948 |
| 327923 | 341 | cyclic AMP-regulated phosphoprotein, 21 kD containing mir-128b | GTGATTTGCTGGAATTGTCATTAGTGTTGACGA TGTGTCACACTGTGTAAGGGAATCGCATGGAGA TGGGCATTCCGAACTGTTAATGGGGACATGGGA CTCCAGTTGTCTCTGATCACTTGTGTGGATTTT CCTGGCGTAGAACGACAGAAGCCGCTAGTAAGT CGCCAAGACCTACAGCAGGAATTCTGCACCAAA GGGCATAAAATCTTGTTATTTTAATTTGCATCT GGGAGAATGTCTGAGCAAGGAGAC | 1949 |
| 327932 | 350 | transient receptor potential cation channel, subfamily M, member 3 containing mir-204 | TAAATGAAAGCAACAGGAGCTGCTCCGGGGACT GCTTTTGCCAGCACCCAGAATCAGTGCTCAGGC TCAGAAATCCTGGATAGAAAGAGCATTTTATAA AAGAGAATGTGTCCACATCATACCCAGCACCAA AGACCCCCATAGGTGTTGCTGTGGGCGTCTGAT AGGCCAGCATGCTGGCCTCACCCCCAGTATCTC CGTGCTTCAGAATGAGAAAAATGAAAGTCGCCT CTCCCGAAATGACATCCAGTCTGA | 1950 |
| 327946 | 364 | melastatin 1 containing mir-211 | GGCTGAAAGAGCCTGAGCTGTGCCTCTCCATTC CACTGCTGTGGCAGGGTCAGAAATCTTGGATAG AGAAAACCTTTTGCAAACGGGAATGTATCTTTG TAATTCCTAGCACGAAAGACTCTAACAGGTGTT GCTGTGGCCAGTTCACCAACCAGCATATCCCCC CTCTGCCAAGTGCAACACCCAGCAAAAATGAAG AGGAAAGCAAACAGGTGGAGACTCAGCCTGAGA AATGGTCTGTTGCCAAGCACACCC | 1951 |
| 327947 | 365 | RNA cyclase homolog containing mir-101-3 | CTCAGCTACGCAGGTGCAACTTCTTGCGCCAAC GTCTGGTCCTGTCTACCCTGAGCGGGCGCCCCG TCAAAATCCGAAAGATTCGGGCCAGAGACGACA ACCCGGGCCTCCGAGATTTTGAAGCCAGCTTCA TAAGGCTATTGGACAAATAACGAATGGTTCTCG AATTGAAATAAACCAAACAGGAACAACCTTATA TTATCAGCCTGGCCTCCTGTATGGTGGATCTGT GGAACATGACTGTAGCGTCCTTCG | 1952 |
| 327954 | 372 | CGI-120 protein containing mir-148b | TTTTGCGGCTCCACGTCGGCACCAGCTGCGGGG CAAGATGGAGGCGCTGATTTTGGAACCTTCCCT GTATACTGTCAAAGCCATCCTGATTCTGGACAA TGATGGAGATCGACTTTTTGCCAAGTACTATGA CGACACCTACCCCAGTGTCAAGGAGCAAAAGGC CTTTGAGAAGAACATTTTCAACAAGACCCATCG | 1953 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | GACTGACAGTGAAATTGCCCTCTTGGAAGGCCT GACAGTGGTATACAAAAGCAGTAT | |
| 327963 | 381 | nuclear LIM interactor-interacting factor containing mir-26b | CGCCTAGCCGCGCCGGTCCCAGAAGTGGCGAAA GCCGCAGCCGAGTCCAGGTCACGCCGAAGCCGT TGCCCTTTTAAGGGGGAGCCTTGAAACGGCGCC TGGGTTCCATGTTTGCATCCGCCTCGCGGGAAG GAAACTCCATGTTGTAACAAAGTTTCCTCCGCG CCCCCTCCCTCCCCCTCCCCCCTAGAACCTGGC TCCCCTCCCCTCCGGAGCTCGCGGGGATCCCTC CCTCCCACCCCTCCCCTCCCCCCC | 1954 |
| 327964 | 382 | COPZ2 for nonclathrin coat protein zeta-COP containing mir-152 | GGCGGCGAGCGGAATGCAGCGGCCCGAGGCCTG GCCACGTCCGCACCCGGGGGAGGGGCCGCGGC GGCCCAGGCCGGGGGCCCGGCGCCGCCTGCTCG AGCCGGGGAGCCCTCGGGGCTGCGGTTGCAGGA ACCTTCCCTCTACACCATCAAGGCTGTTTTCAT CCTAGATAATGACGGGCGCCGGCTGCTGGCCAA GTATTATGATGACACATTCCCCTCCATGAAGGA GCAGATGGTTTTCGAGAAAAATGT | 1955 |
| 327967 | 385 | hypothetical protein PRO2730 containing let-7g | GGCTGGAAGGTTTAGCAGCAGCCTGGTGCAGTG CCCTGTCATCAAGACAAACCCACGGTCCTCCTG GGTGCCTACCAAGCTTGGTTTGTACAAAAGCAA GGTGGGAGTCTATTTTTGTACATGAGATACATC ACACTTACCTGTGGGCCAGTATTGTGAAGTGAG TCTGAGTTGTTTACACTGATGCCTTCCCTGCCC ACCACAAATTGTGTACATAGTCTTCAGATGATA CCACCCCTTTCCCCAGCTCCCAAC | 1956 |
| 327968 | 386 | sterol regulatory element-binding protein-1/mir-33b | TAACGAGGAACTTTTCGCCGGCGCCGGGCCGCC TCTGAGGCCAGGGCAGGACACGAACGCGCGGAG CGGCGGCGGCGACTGAGAGCCGGGGCCGCGGCG GCGCTCCCTAGGAAGGGCCGTACGAGGCGGCGG GCCCGGCGGGCCTCCCGGAGGAGGCGGCTGCGC CATGGACGAGCCACCCTTCAGCGAGGCGGCTTT GGAGCAGGCGCTGGGCGAGCCGTGCGATCTGGA CGCGGCGCTGCTGACCGACATCGA | 1957 |
| 328089 | 391 | talin 2 containing hypothetical miR-13/miR-190 | GGTTCCCAGGCACAGGAACCAATCCTGGTCTCA GCCAAGACCATGCTGGAGAGTTCATCGTACCTC ATTCGCACTGCACGCTCTCTGGCCATCAACCCC AAAGACCCACCCACCTGGTCTGTACTGGCTGGA CATTCCCATACAGTGTCCGACTCCATCAAGAGT CTCATCACTTCTATCAGGGACAAGGCCCCTGGA CAGAGGGAGTGTGATTACTCCATCGATGGCATC AACCGGTGCATCCGGGACATCGAG | 1958 |
| 328091 | 393 | calcitonin receptor containing hypothetical miRNA 30 | CAGAATTCCAGGACAAAGAGATCTTCAAAAATC AAAAATGAGGTTCACATTTACAAGCGGGTGGTT GGCACTGTTTCTTCTTCTAAATCACCCAACCCC AATTCTTCCTGCCTTTTCAAATCAAACCTATCC AACAATAGAGCCCAAGCCATTTCTTTACGTCGT AGGACGAAAGAAGATGATGGATGCACAGTACAA ATGCTATGACCGAATGCAGCAGTTACCCGCATA CCAAGGAGAAGGTCCATATTGCAA | 1959 |
| 328092 | 394 | glutamate receptor, ionotrophic, AMPA 3/hypothetical miRNA-033 | TGACGACTCCTGAGTTGCGCCCATGCTCTTGTC AGCTTCGTTTTAGGCGTAGCATGGCCAGGCAGA AGAAAATGGGGCAAAGCGTGCTCCGGGCGGTCT TCTTTTTAGTCCTGGGGCTTTTGGGTCATTCTC ACGGAGGATTCCCCAACACCATCAGCATAGGTG GACTTTTCATGAGAAACACAGTGCAGGAGCACA GCGCTTTCCGCTTTGCCGTGCAGTTATACAACA CCAACCAGAACACCACCGAGAAGC | 1960 |
| 328093 | 395 | myosin, heavy polypeptide 7B, cardiac muscle, beta containing hypothetical miRNA 039 | AGTTCATCCGCATTCACTTTGGTCCCTCTGGGA AGCTGGCATCCGCGGATATTGACAGCTATCTCC TGGAGAAGTCGCGGGTGATCTTCCAGTTGCCTG GTGAGCGCAGCTACCATGTCTACTACCAGATCC TCTCAGGGAGGAAGCCAGAGCTGCAGGACATGC TGCTTCTGTCTATGAACCCCTATGACTACCACT | 1961 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | TCTGCAGCCAGGGCGTCATCACCGTGGACAACA TGAATGATGGGGAGGAGCTCATCG | |
| 328101 | 403 | LOC 114614/ hypothetical miRNA-071 | AGCGGAGCCCCGAGCCGCCCGCAGAGCAAGCGC GGGGAACCAAGGAGACGCTCCTGGCACTGCAGA TAACTTGTCTGCATTTCAAGAACAACCTACCAG AGACCTTACCTGTCACCTTGGCTCTCCCACCCA ATGGAGATGGCTCTAATGGTGGCACAAACCAGG AAGGGGAAATCTGTGGTTTAAATTCTTTATGCC TCATCCTCTGAGTGCTGAAGGCTTGCTGTAGGC TGTATGCTGTTAATGCTAATCGTG | 1962 |
| 328104 | 406 | dachshund (Drosophila) homolog containing hypothetical miRNA 083 | GCGGCCGCGAGCAACGGCAGCGGCGGCGGCGGC GGCGGCATCAGCGCTGGCGGCGGCGTCCCTTCC AGCACCCCCATCAACGCCAGCACCGGCAGCAGC AGCAGCAGCAGTAGCAGCAGCAGCAGCAGCAGC AGTAGTAGCAGCAGCAGCAGTAGCAGCAGCAGC TGCGCCCCCCTCCCCGGGAAACCCGTGTACTCA ACCCCGTCCCCAGTGGAAAACACCCCTCAGAAT AATGAGTGCAAAATGGTGGATCTG | 1963 |
| 328105 | 407 | DiGeorge syndrome critical region gene 8/ hypothetical miRNA-088 | TCTCAGCGGACTTGTGCATGTTAGCTGTGTAGA TTTATGTGAGGGCTTGTAAAACTCTGGTCTTGT AAACTAGTCTTAAGCGCTTTTAATATGGAGACA GATGAGAGCCCCTCTCCGCTCCCGTGTGGGCCC GCAGGAGAAGCGGTGATGGAGAGCCGAGCTCGC CCCTTCGAAGCGCTGCCCCGTGAGCAGTCTCCA CCACCTCCCCTGCAAACGTCCAGTGGTGCAGAG GTAATGGACGTTGGCTCTGGTGGT | 1964 |
| 328111 | 413 | hypothetical protein FLJ21016, containing hypothetical miRNA 111 | CTACGTGCAAAAGCAGAATGGGAAGGCTAAGGG ACAGCTTCCCGATCTAAACTATTGGATAAACTT CAGACCTATTTACCACCATCAGTGATGCTTCCC CCACGGCGTTTACAGACTCTCCTGCGGCAGGCG GTGGAACTACAAAGGGATCGGTGCCTATATCAC AATACCAAACTTGATAATAATCTAGATTCTGTG TCTCTGCTTATAGACCATGTTTGTAGTAGGAGG CAGTTCCCATGTTATACGCAGCAG | 1965 |
| 328117 | 419 | collagen, type I, alpha 1/ hypothetical miRNA-144 | agcagacgggagtttctcctcggggtcggagca ggaggcacgcggagtgtgaggccacgcatgagc ggacgctaaccccctccccagccacaaagagtc tacatgtctagggtctagacatgttcagctttg tggacctccggctcctgctcctcttagcggcca ccgcccctcctgacgcacggccaagaggaaggcc aagtcgagggccaagacgaagacatcccaccaa tcacctgcgtacagaacggcctca | 1966 |
| 328119 | 421 | hypothetical protein HH114 containing hypothetical miRNA 154 | GGCACGAGGCTGGTCGCTGGCCCAACATGATAC TGACCAAAGCTCAGTACGACGAGATAGCCCAGT GCCTAGTGTCTGTGCCGCCTACCAGGCAGAGCC TGAGGAAGCTGAAGCAGAGGTTTCCCAGTCAAT CGCAGGCCACTCTGCTGAGCATCTTCTCCCAGG AGTACCAGAAACACATTAAAAGAACACATGCCA AACATCATACTTCGGAAGCAATTGAAAGTTATT ACCAGAGGTACCTGAATGGAGTGG | 1967 |
| 328120 | 422 | sprouty (Drosophila) homolog 4 containing hypothetical miRNA 156 | GCGAGCTGAGCTGAGAGCGCGGAGCTGGCGCTG TGGAGCGCAGGGAGCCTTGCCGGTTCCTCCGAC CGGCGTCTGCGAGTACAGCGGCGGCTAACCTGC CCCGGCTTCAGGATTTACACAGACGTGGGCGA TGCTTGTGACCCTGCAGCTCCTCAAACCAGCCT GTATTGAGCGGTTTGCAGCCTGATGCTCAGCCC CCTCCCCACAGGGCCCCTAGAAGCCTGTTTCTC CGTACAGTCCAGGACCTCCAGCCC | 1968 |
| 328124 | 426 | ribosomal protein L5/hypothetical miRNA 168-2 | GAGCAGCGGACGCCGGTCTCTGTTCCGCAGATG GGGTTTGTTAAAGTTGTTAAGAATAAGGCCTAC TTTAAGAGATACCAAGTGAAATTTAGAAGACGA CGAGAGGGTAAAACTGATTATTATGCTCGGAAA CGCTTGGTGATACAAGATAAAAATAAATACAAC ACACCCAAATACAGGATGATAGTTCGTGTGACA | 1969 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | AACAGAGATATCATTTGTCAGATTGCTTATGCC CGTATAGAGGGGGATATGATAGTC | |
| 328125 | 427 | forkhead box P2/hypothetical miRNA 169 | ATGATGCAGGAATCTGCGACAGAGACAATAAGC AACAGTTCAATGAATCAAAATGGAATGAGCACT CTAAGCAGCCAATTAGATGCTGGCAGCAGAGAT GGAAGATCAAGTGGTGACACCAGCTCTGAAGTA AGCACAGTAGAACTGCTGCATCTGCAACAACAG CAGGCTCTCCAGGCAGCAAGACAACTTCTTTTA CAGCAGCAAACAAGTGGATTGAAATCTCCTAAG AGCAGTGATAAACAGAGACCACTG | 1970 |
| 328127 | 429 | glutamate receptor, ionotropic, AMPA 2/hypothetical miRNA 171 | AGGGATTCTTCTGCCTCCACTTCAGGTTTTAGC AGCTTGGTGCTAAATTGCTGTCTCAAAATGCAG AGGATCTAATTTGCAGAGGAAAACAGCCAAAGA AGGAAGAGGAGGAAAAGGAAAAAAAAAGGGGTA TATTGTGGATGCTCTACTTTTCTTGGAAATGCA AAAGATTATGCATATTTCTGTCCTCCTTTCTCC TGTTTTATGGGGACTGATTTTTGGTGTCTCTTC TAACAGCATACAGATAGGGGGGCT | 1971 |
| 328128 | 430 | potassium large conductance calcium-activated channel, subfamily M, alpha member 1 containing hypothetical miRNA 172 | GGCGGCGGAGGCAGCAGTCTTAGAATGAGTAGC AATATCCACGCGAACCATCTCAGCCTAGACGCG TCCTCCTCCTCCTCCTCCTCCTCTTCCTCTTCT TCTTCTTCCTCCTCCTCTTCCTCCTCGTCCTCG GTCCACGAGCCCAAGATGGATGCCGTGCCATCATC CCGGTGACCATGGAGGTGCCGTGCGACAGCCGG GGCCAACGCATGTGGTGGGCTTTCCTGGCCTCC TCCATGGTGACTTTCTTCGGGGGC | 1972 |
| 328131 | 433 | hypothetical protein FLJ20307 | ATGTATTGAAAGGGTATGTATAGGTGCAAATGA TAAAAAAGAAGAGTTTGATGTTTCCGGAAATGG AAGGATTGAAGGCCATATAGGTGTGCAATTACA AGAGCATTCCTATCTTGAGAAGGGCATGCTGGC GTCTGAGGAACTGTCACAGTCTCGTGGTAGCAC CAAAGATGATGAATTAGCTTCAACCACTACTCC AAAGAGAGGGAGACCTAAAGGTAACATCTCACG GACGTGTTCACACTGTGGCCTTTT | 1973 |
| 328135 | 437 | cezanne 2/ hypothetical miRNA-180 | GTTCTCTCGGTCAGGTCTCTGCATGTAGTTGTC ACTTGCAGCTCCATTTCCATCACGTGGTAAAAT GCCCTTTCTCTTCTTTCCTGCAGATGGATGGTT TCTAGTGTGCTTCCAAACCCCACCTCGGCTGAG TGTTGGGCAGCACTTCTACATGATCCTATGACT CTTGATATGGACGCAGTCCTGTCAGACTTTGTT CGGTCCACGGGGGCAGAACCTGGTCTGGCCAGA GACCTGCTGGAAGGCAAAAACTGG | 1974 |
| 328137 | 439 | tight junction protein 1 (zona occludens 1)/ hypothetical miRNA-183 | TCCGGGTATGGATGTCAATCTTTTGTCTACAAT GTGAATACATTTATCCTTCGGGGACCATCAAGA CTTTCAGGAAAGGCCCCGCCTGTCTCTGCGCGG CCACTTTGCTGGGACAAAGGTCAACTGAAGAAG TGGGCAGGCCCGAGGCAGGAGAGATGCTGAGGA GTCCATGTGCAGGGGAGGGAAAGGGAGAGGCAG TCAGGGAGAGGAGGAGGAGGTACCGCCAGAAGG GGATCCTCCCGCTCCGAAAACCAG | 1975 |
| 340343 | 1780 | gamma-aminobutyric acid (GABA) A receptor, alpha 3 containing miR-105 (Mourelatos) and miR-105-2 | GAATTCCTTGTTTCAGTTCATTCATCCTTCTCT CCTTTCCGCTCAGACTGTAGAGCTCGGTCTCTC CAAGTTTGTGCCTAAGAAGATGATAATCACACA AACAAGTCACTGTTACATGACCAGCCTTGGGAT TCTTTTCCTGATTAATATTCTCCCTGGAACCAC TGGTCAAGGGGAATCAAGACGACAAGAACCCGG GGACTTTGTGAAGCAGGACATTGGCGGGCTGTC TCCTAAGCATGCCCCAGATATTCC | 1976 |
| 340348 | 848 | Minichromosome maintenance deficient (S. cerevisiae) 7 containing miR-93 | GACGTTTCGCGCCAATTTCGGTTGGCCGGCCAC AGTCCACCGCGCGGAGATTCTCAGCTTCCCCAG GAGCAAGACCTCTGAGCCCGCCAAGCGCGGCCG CACGGCCCTCGGCAGCGATGGCACTGAAGGACT ACGCGCTAGAGAAGGAAAAGGTTAAGAAGTTCT | 1977 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | (Mourelatos) and miR-25 and miR-94 | TACAAGAGTTCTACCAGGATGATGAACTCGGGA AGAAGCAGTTCAAGTATGGGAACCAGTTGGTTC GGCTGGCTCATCGGGAACAGGTGG | |
| 340350 | 855 | KIAA1808 protein containing miR-95 (Mourelatos) | CGAGGTGCTGCGGGTGCAGGACAAGTACTTCCA CATCAAGTGCTTCGTCTGTAAAGCATGTGGCTG CGACCTGGCCGAGGGCGGCTTCTTCGTGCGGCA GGGCGAGTACATCTGCACGCTGGACTACCAGAG GCTCTACGGCACCCGCTGCTTCAGCTGCGACCA GTTCATTGAGGGTGAGGTGGTGTCGGCGCTGGG CAAGACCTACCACCCCGACTGCTTCGTGTGTGC CGTCTGCCGGCTGCCCTTCCCCCC | 1978 |
| 340356 | 1853 | LIM domain-containing preferred translocation partner in lipoma containing miR-28 | GTCACTTTTATTTGGGGGTGTGGACAGCTGCTT TCCCAGGGGAGTACTTCTTACAGTGGGATTTCA AGACAAGATCGGCCTGAAGAAAAATTATATTTG TATATTTTTTAAAAAGTGGGAACTTTGAGGCTC AGAGACAGAGCAGAAGACAGAACCTGGTCTTCT GATTCCCTGTGTTCTGCTTTTTTCATTGTTCCA CTGGACGCTCATCAGAGGGAAGATCTTTTTCCT CAATTGATTCCAACAATGTCTCAC | 1979 |
| 340360 | 1865 | chromosome 9 open reading frame 5 containing miR-32 | CGCCCCTCGGGGCGGCTGTGGCGGAGGAACGA TGGCCGACGGCGGCGGCCCTAAGGAGGCGCCAA GCCTGCGGAGCTCTCCCGGGCCGGCGCCGCGGG TCCCGCGCGCGGTCGGGCCGAGTGGCGGTGGCG GGGAGACCCCGCGGACCGCGGCGCTGGCGCTGC GCTTCGACAAGCCCATTAAGCAGGCCTTCTACA ACACCGGGGCCGTGCTGTTCGTGTGCCTGTGCT GCGGCGCCGCGGTGCTGGTCTACT | 1980 |
| 341785 | 854 | glypican 1 containing miR-149 | GGCTGCCCGAGCGAGCGTTCGGAGCTGGCACCC CGCGCGCCCCGCGCCGCCGCCGCCGCCGGCTTT TGTTGTCTCCGCCTCCTCGGCCGCCGCCGCCTC TGGACCGCGAGCCGCGCGCGCCGGGACCTTGGC TCTGCCCTTCGCGGGCGGGAACTGCGCAGGACC CGGCCAGGATCCGAGAGAGGCGCGGGCGGGTGG CCGGGGGCGCCGCCGGCCCCGCCATGGAGCTCC GGGCCCGAGGCTGGTGGCTGCTAT | 1981 |
| 341798 | 1871 | Notch 4 like containing mir-123/mir-126 | CCGCCTGGAGGCACAGGCCATGAGGGGCTCTCA GGAGGTGCTGCTGATGTGGCTTCTGGTGTTGGC AGTGGGCGGCACAGAGCACGCCTACCGGCCCGG CCGTAGGGTGTGTGCTGTCCGGGCTCACGGGGA TCCTGTCTCCGAGTCGTTCGTGCAGCGTGTGTA CCAGCCCTTCCTCACCACCTGCGACGGGCACCG GGCCTGCAGCACCTACCGAACCATCTATAGGAC CGCCTACCGCCGCAGCCCTGGGCT | 1982 |
| 341800 | 1766 | zinc finger protein 265 containing miR-186 | ATGTCGACCAAGAATTTCCGAGTCAGTGACGGG GACTGGATTTGCCCTGACAAAAAATGTGGAAAT GTAAACTTTGCTAGAAGAACCAGCTGTAATCGA TGTGGTCGGGAGAAAACAACTGAGGCCAAGATG ATGAAAGCTGGGGGCACTGAAATAGGAAAGACA CTTGCAGAAAAGAGCCCAGGCCTATTTAGTGCT AATGACTGGCAATGTAAAACTTGCAGCAATGTG AATTGGGCCAGAAGATCAGAGTGT | 1983 |
| 341801 | 1839 | follistatin-like 1 containing miR-198 | GGAGCTCCAACCTCCGCTTAGAGCTCGCTGCGG CCGTCCTGCCCCGTGCCCTCGGAGACCTGGACC GTACCACGATGTGGAAACGCTGGCTCGCGCTCG CGCTAGCGCTGGTGGCGGTCGCCTGGGTCCGCG CCGAGGAAGAGCTAAGGAGCAAATCCAAGATCT GTGCCAATGTGTTTTGTGGAGCTGGCCGGGAAT GTGCAGTCACAGAGAAAGGGGAACCCACCTGTC TCTGCATTGAGCAATGCAAACCTC | 1984 |
| 341802 | 1806 | hypothetical protein FLJ10496 containing miR-191 | CCTTCCGGTCACCATGGCGACCAGGCGCCTTGG GGTCGGGGAGACGCTGGGGGCCCTCAACGCGGC CCTGGGGCCAGGCGGTCCGGTGTGGACCAAGGA GACGCGCACCCGCCACCTGCGTTCCCGAGACTT TCTGGCACCGCACCGCGCGCTGCAGGCGCGCTT | 1985 |

TABLE 67-continued

Oligomeric compounds targeting miRNAs found within introns or exons

| ISIS # | SEQ ID NO: | Locus containing miRNA | Sequence of locus | Locus SEQ ID NO |
|---|---|---|---|---|
| | | | CGATGACGGCCAGGTTCCGGAGCATTTGCTCCA TGCCCTCGCCTGCCTGCAGGGCCCCGGTGTGGC CCCGGTGCTGCGCTGCGCGCCGAC | |
| 341808 | 1861 | hypothetical protein DKFZp761P1121, containing miR-185 | TCGGCGGCGGTGGCGGAGGCGACCTCGCGACCT GTGTCAGCAGAGCCGCCCTGCACCACCATGTGC ATCATCTTCTTTAAGTTTGATCCTCGCCCTGTT TCCAAAAACGCGTACAGGCTCATCTTGGCAGCC AACAGGGATGAATTCTACAGCCGACCCTCCAAG TTAGCTGACTTCTGGGGGAACAACAACGAGATC CTCAGTGGGCTGGACATGGAGGAAGGCAAGGAA GGAGGCACATGGCTGGGCATCAGC | 1986 |
| 341809 | 1786 | chloride channel 5 (nephrolithiasis 2, X-linked, Dent disease) containing miR-188 | TGATGTGATATGGCTGCAAGTGCCTTTGACCCT TTTGTCTCCCTTCCATAAACTGAAATACCTAAG CTGCTCCAACCTCCTTTTTGTCTTTTGTTTCAT AAATCCTTTCCCATTGCACATCAACTCCTGTCT CTCTTTGTACTGTCACTCTCATCTGTTGCTTTC CATTCACACTGCCTTTAGCCACTCATCATTTTG TGCCTACACCACAGAAACCTCTGAATGTAATGG ATGTTCCTACCAGAGGACAAGTCG | 1987 |
| 341812 | 1771 | myosin, heavy polypeptide 6, cardiac muscle, alpha (cardiomyopathy, hypertrophic 1) containing miR-208 | GAGGCTGTTAATGGCAAATGCTCCTCACTGGAG AAGACCAAGCACCGGCTACAGAATGAGATAGAG GACTTGATGGTGGACGTAGAGCGCTCCAATGCT GCTGCTGCTGCTCTGGACAAGAAGCAGAGGAAC TTTGACAAGATCCTGGCCGAGTGGAAGCAGAAG TATGAGGAGTCGCAGTCTGAGCTGGAGTCCTCA CAGAAGGAGGCTGGCTCCCTCAGCACAGAGCTC TTCAAGCTCAAGAACGCCTACGAG | 1988 |
| 341813 | 938 | phosphodiesterase 2A, cGMP-stimulated containing miR-139 | CAGCAGAGCTGGATTGGGGTGTTGAGTCCAGGC TGAGTAGGGGGCAGCCCACTGCTCTTGGTCCGT GTGCCTGCTGGGGGTGCCCTGCCCTGAACTCCA GGCAGCGGGGACAGGGCGAGGTGCCACCTTAGT CTGGCTGGGGAGGCGGACGATGAGGAGTGATGG GGCAGGCATGCGGCCACTCCATCCTCTGCAGGA GCCAGCAGTACCCGGCAGCGCGACCGGCTGAGC CGCGGGGCCAGCAGGTCTTCCTCA | 1989 |
| 344611 | 1785 | mesoderm specific transcript (mouse) homolog containing mir-240* (Kosik) | CGGCCAGCACACCCCGGCACCTCCTCTGCGGCA GCTGCGCCTCGCAAGCGCAGTGCCGCAGCGCAC GCCGGAGTGGCTGTAGCTGCCTCGGCGCGGCTG CCGCCCTGCGCGGGCTGTGGGCTGCGGGCTGCG CCCCCGCTGCTGGCCAGCTCTGCACGGCTGCGG GCTCTGCGGCGCCCGGTGCTCTGCAACGCTGCG GCGGGCGGCATGGGATAACGCGGCCATGGTGCG CCGAGATCGCCTCCGCAGGATGAG | 1990 |
| 344615 | 1900 | Apoptosis-associated tyrosine kinase containing mir-244* (Kosik) | CTCCAGACCTACCCAGAAAGATGCCCGGATGGA TCCTGCAGCTCCGTGGCTTTTCTGGGAAGCAGC GGCCCGTGCTCTCAAGAGACCCTGGCTGCTGAT GGTGGCCCCAAGGTTGCCAGCTGGTGCTAGGGA CTCAGGACAGTTTCCCAGAAAAGGCCAAGCGGG CAGCCCCTCCAGGGGCCGGGTGAGGAAGCTGGG GGGTGCGGAGGCCACACTGGGTCCCTGAACCCC CTGCTTGGTTACAGTGCAGCTCCT | 1991 |
| 344617 | 1862 | RNB6 containing mir-248* (Kosik) | GGCACGAGTGGGAGTACAGGACTCGCCTCCTCA GGGTTCCCTGTGCTGCCACTTTTCAGCCATGGC CACAAGTGAACAGAGTATCTGCCAAGCCCGGGC TTCCGTGATGGTCTACGATGACACCAGTAAGAA ATGGGTACCAATCAAACCTGGCCAGCAGGGATT CAGCCGGATCAACATCTACCACAACACTGCCAG CAACACCTTCAGAGTCGTTGGAGTCAAGTTGCA GGATCAGCAGGTTGTGATCAATTA | 1992 |
| 346692 | 1889 | gamma-aminobutyric acid (GABA) A receptor, epsilon, | GCCAGAGCGTGAGCCGCGACCTCCGCGCAGGTG GTCGCGCCGGTCTCCGCGGAAATGTTGTCCAAA GTTCTTCCAGTCCTCCTAGGCATCTTATTGATC CTCCAGTCGAGGGTCGAGGGACCCTCAGACTGAA TCAAAGAATGAAGCCTCTTCCCGTGATGTTGTC | 1993 |

TABLE 67-continued

Oligomeric compounds targeting miRNAs found within
introns or exons

| ISIS # | SEQ ID NO: | Locus containing miRNA | Sequence of locus | Locus SEQ ID NO |
|---|---|---|---|---|
| | | containing miR-224 (Sanger) | TATGGCCCCCAGGCCCAGCCTCTGGAAAATCAG CTCCTCTCTGAGGAAACAAAGTCAACTGAGACT GAGACTGGGAGCAGAGTTGGCAAA | |
| 348128 | 1858 | Nuclear transcription factor Y, gamma containing miR-30c-2 and miR-30e | ACGCGTCCGGGGAAACGGTGCAAACGGCGTGGC CGCCATCTTGCTTGTGCCCCCGCTTCGCGCGCG CTCCGTGACGCACACTTCCCCCCTCCCCTCCGC CGCGCCTGGGCCTCTGCATTGCCCGACTCCGTA GGAGCGCGGGGCGGCTCCTGCTCTTCCTGGAC TCCTGAGCAGAGTTGTCGAGATGTCCACAGAAG GAGGATTTGGTGGTACTAGCAGCAGTGATGCCC AGCAAAGTCTACAGTCGTTCTGGC | 1994 |

Example 36

Oligomeric Compounds Targeting Components of the RNAi Pathway

In one step of miRNA processing, the pre-miRNAs, approximately 70 to 110 nucleotides in length, are processed by the human Dicer RNase into mature miRNAs. The Dicer enzyme is conserved from fungi to vertebrates. The helicase-moi gene is the human homolog of Dicer from *Drosophila*. Human Dicer is required for the production of active small non-coding RNAs involved in repressing gene expression by the RNA interference pathway; targeted destruction in cultured human cells of the mRNA encoding human Dicer leads to accumulation of the let-7 pre-miRNA (Hutvagner, et al., 2001, *Science* 293(5531):834-8). Furthermore, the zebrafish Dicer1 ortholog was cloned and its expression disrupted by target-selected gene inactivation; in homozygous dicer1 mutants, an initial build-up of miRNA levels produced by maternal Dicer1 was observed, but miRNA accumulation halted after a few days, and a developmental arrest was observed at around day 10, indicating that miRNA-producing Dicer1 is essential for vertebrate development (Wienholds, et al., 2003, *Nat Genet.*, 35(3):217-8). The Dicer gene has also been disrupted in mice. Loss of Dicer1 led to lethality early in development, with Dicer1-null embryos depleted of stem cells. Coupled with the inability to generate viable Dicer1-null embryonic stem cells, this suggests a role for Dicer and, by implication, the RNAi machinery in maintaining the stem cell population during early mouse development (Bernstein, et al., 2003, *Nat Genet.*, 35(3):215-7).

Thus, it was predicted that treatment of cells with oligomeric compounds targeting human Dicer would result in an increase in expression levels of miRNA precursor structures, and thus would be useful in increasing the sensitivity of or enabling the detection of certain pre-miRNAs and/or pri-miRNAs otherwise beneath the limits of detection. It was also predicted that treatment of cells with oligomeric compounds targeting human Dicer would result in a decrease in mature miRNAs, leading to dysregulation of miRNA-regulated targets. Thus, a transcriptomics- or proteomics-based approach could be used to compare and identify target RNAs or proteins for which changes in expression levels correlate directly or inversely with the changes in mature miRNA levels. Target RNAs or their downstream protein products which are being misregulated upon treatment with oligomeric compounds targeting human Dicer, can thereby lead to the identification of any potential miRNA-regulated targets.

The present invention provides methods of maintaining a pluripotent stem cell comprising contacting the cell with an effective amount of an oligomeric compound targeting human Dicer. The pluripotent stem cell can be present in a sample of cord blood or bone marrow, or may be present as part of a cell line. In addition, the pluripotent stem cell can be an embryonic stem cell.

In some embodiments, oligomeric compounds ISIS Number 138648 (GCTGACCTTTTTGCTTCTCA; herein incorporated as SEQ ID NO: 1995) and ISIS Number 138678 (CATAAACATTTCCATCAGTG; herein incorporated as SEQ ID NO: 1996), both 5-10-5 2'-MOE gapmers with phosphorothioate backbones, were designed to target the human Dicer mRNA. These oligomeric compounds were used to transfect the A549, T-24, HepG2, HMEC, T47D, HuVEC, and MCF7 cell lines, as well as human primary dendritic cells, preadipocytes, differentiated adipocytes, and human spleen tissue, and the effects of treatment with the oligomeric compounds on phenotypic parameters, such as caspase activity and expression of markers of adipocyte differentiation (aP2, HSL, Glut4) was assessed as described in Examples 11 and 13, respectively.

Interestingly, treatment of T47D breast adenocarcinoma (p53 mutant) cells with the oligomeric compound ISIS 138648 targeting human Dicer was observed to result in a 41% increase in caspase activity. This phenotype is similar to the effect of treatment of T47D cells with oligomeric compound ISIS Number 328645 (SEQ ID NO: 554), targeting mir-124a-1 described in Example 11. It is believed that treatment of T47D cells with the oligomeric compound ISIS 138648 inhibits expression of human Dicer, which results in reduced production of mature miRNAs. Inadequate levels of miRNAs or inappropriately elevated levels of miRNA precursors may disrupt important cellular events, such as regulation of the cell cycle, and lead cells to trigger apoptotic pathways.

In adipocyte differentiation assays performed as described in Example 13, treatment of human white preadipocytes with ISIS Number 138648 targeting human Dicer was observed to result in decreased triglyceride production. An increase in triglyceride content is a well-established marker of adipocyte differentiation; treatment of adipocytes with oligomeric compound ISIS 138648 resulting in a decrease in triglyceride levels indicates an apparent inhibition of adipocyte differentiation. Thus, the oligomeric compound ISIS 138648 targeting human Dicer may be useful as a pharmaceutical agent with applications in the treatment, attenuation or prevention of obesity, hyperlipidemia, atherosclerosis, atherogenesis, diabetes, hypertension, or other metabolic diseases as well as in the maintenance of the undifferentiated, pluripotent phenotype of stem or precursor cells. The inhibition of expression of human Dicer by ISIS 138648 is believed to result in decreased production of miRNAs, and some of these miRNAs may be critical for proper regulation of the cell cycle (such as is predicted for the regulation of ERK5 by mir-143); treatment of preadipocytes with this inhibitor of human Dicer and the resulting decrease in production of mature miRNAs, as well as the concommitant accumulation of pre-miRNAs or pri-miRNAs may upset the balance between cellular proliferation and differentiation, predisposing cells to an undifferentiated state.

Example 37

Design of Additional Double-Stranded miRNA Mimics

As described supra, a reporter vector system employing, for example, the pGL3-bulge(×3) plasmid or the pGL3-mir-143 sensor plasmids can be used to assess the ability of miRNA mimics to bind target sites or to assess their effects on the expression of miRNAs, pre-miRNAs or pri-miRNAs. Various chemically modified miRNA mimics have been designed and synthesized for this purpose. The oligomeric compounds of the present invention can be designed to mimic a pri-miRNA, pre-miRNA or a single- or double-stranded miRNA while incorporating certain chemical modifications that alter one or more properties of the mimic, thus creating a construct with superior qualities over the endogenous precursor or miRNA.

In accordance with the present invention, a series of oligomeric compounds was designed and synthesized to mimic double-stranded miRNAs. In some embodiments, various oligomeric compounds representing the sense strand of the mir-143 miRNA, were synthesized, incorporating various chemically modified sugars and/or internucleoside linkages. Similarly, various oligomeric compounds representing the antisense strand complementary to the mir-143 miRNA were synthesized, incorporating various chemically modified sugars and/or internucleoside linkages. The antisense and sense oligomeric compounds designed to mimic mir-143 are shown in Table 68 and 69, respectively. All of the sugar moieties of the oligomeric compounds listed in Tables 68 and 69 are ribonucleotides unless otherwise indicated, and the 3'-terminal nucleosides each have a 3'-OH group unless otherwise specified. The sequences are written in the 5' to 3' direction. All antisense oligomeric compounds in Table 68 have the nucleotide sequence GAGCUACAGUGCUUCAUCUCA (herein incorporated as SEQ ID NO: 1864). The sense oligomeric compounds in Table 69 have one of three nucleotide sequences which only differ in that there is a thymidine substitution in place of uridine in two of the sequences; these are: UGAGAUGAAGCACUGUAGCUC (herein incorporated as SEQ ID NO: 1088), UGAGATGAAGCACUGUAGCUC (herein incorporated as SEQ ID NO: 1088), and UGAGAUGAAGCACUGTAGCUC (herein incorporated as SEQ ID NO: 1088). In Tables 68 and 69, the column "Chemical modification" lists the general class and type of chemical modification for the respective oligomeric compounds. The column "Sequence" indicates the nucleobase sequence with symbols indicating sugar and linkage modifications. In the Sequence columns of Tables 68 and 69, internucleoside linkages are assumed to be phosphodiester unless otherwise indicated; phosphorothioate internucleoside linkages are indicated by "s" after the letter indicating the nucleobase (for example, "GsC" indicates a guanosine linked to a cytidine with a 3',5'-phosphorothioate (PS) internucleoside linkage). Other symbols used to indicate sugar and linkage modifications in the Sequence columns of Tables 68 and 69 are as follows: "$^m$C" indicates that the cytidine residue at the specified position is a 5-methylcytidine; replacement of the 2'-OH of the ribosyl sugar with a 2'-O-methoxyethyl (2'-MOE) is indicated by "e" after the letter indicating the nucleobase (for example, "GAe" indicates a guanosine linked to a 2'-MOE adenosine with a 3',5'-phosphodiester internucleoside linkage); replacement or substitution of the 2'-OH of the ribosyl sugar with a 2-O-methyl (2'-OMe) is indicated by "m" after the letter indicating the nucleobase (for example, "CmA" indicates a 2'-O-methyl cytidine linked to an adenosine with a 3', 5'-phosphodiester internucleoside linkage); nucleosides having a 2'-Fluoro (2'-F) substituent group are indicated with a "f" after the letter indicating the nucleobase (for example, "GfAm" indicates a 2'-F guanosine linked to a 2'-O-Methyl-adenosine with a 3',5'-phosphodiester internucleoside linkage); 4'-Thio (4'-S) residues are indicated by "4s" (for example, "GC4s" indicates a guanosine linked to a 4'-S cytidine with a 3',5'-phosphodiester internucleoside linkage).

In the "Chemical modification" column of Tables 68 and 69, "unmodified" indicates a native strand. "Full" indicates a fully modified oligomeric compound where the chemical modification occurs at each nucleoside or internucleoside linkage. For example each nucleoside of the oligomeric compound could have a modified sugar selected from one of 4'-S, 2'-MOE, 2'-F, 2'-O-Methyl, LNA or ENA™ or could have uniformly modified internucleoside linkages such as uniform phosphorothioate internucleoside linkages.

In the "Chemical modification" column of Tables 68 and 69, "Alt" indicates that the nucleosides and or the internucleoside linkages have an alternating motif. The alternating motif can be the result of different sugar modifications that alternate (for example, 2'-ribose alternating with a 2'-modification other than ribose such as MOE, 2'-F or 2'-O-Methyl, or alternating fully modified sugars such as 2'-O-Methyl alternating with 2'-F), or can be the result of alternating internucleoside linkages (for example alternating phosphodiester and phosphorothioate internucleoside linkages). Oligomeric compounds having alternating modifications are described in the chemical modification column with the modification at the first 5'-nucleoside or the first internucleoside linkage at the 5'-end of the nucleoside listed first. For example, oligomeric compounds described as "Alt 2'-F/2'-OMe" have a 2'-F modified sugar at the 5'-terminal nucleoside with the next nucleoside having a 2'-F modified sugar and this alternating pattern is repeated through to the 3'-terminal nucleoside.

In the "Chemical modification" column of Tables 68 and 69, "gapmer" indicates that the oligomeric compound is divided into three distinct regions. The wings are the regions located externally at the 3' and the 5'-end with the gap being the internal region. Gapmers can be the result of differences in linkage (PO vs. PS) or nucleoside (modified sugar moiety or heterocyclic base). Gapmers also include chimeric gapped oligomeric compounds such as when the wings and the gapped regions are all distinct one from each other. Examples of chemistries that can be used to prepare gapped oligomeric compounds include 2'-MOE, 2'-F, 2'-O-Methyl, LNA and ENA™.

In the "Chemical modification" column of Tables 68 and 69, "hemimer" indicates an oligomeric compound that has two distinct regions resulting from differences in the nucleoside or the internucleoside linkage or both. Examples include oligomeric compounds having two regions wherein one region has modified internucleoside linkages such as PS or modified sugar moieties such as 2'-MOE, 2'-F, 2'-O-Methyl, LNA and ENA™.

In the "Chemical modification" column of Tables 68 and 69, "blockmer" indicates an oligomeric compound that has at least one block of modified nucleosides or internucleoside linkages that are located internally. The blocks are generally from two to about five nucleosides in length and are not located at one of the ends as that could be a hemimer. Examples of blockmers include oligomeric compounds having from two to about five internally modified nucleosides such as 2'-MOE, 2'-F, 2'-O-Methyl, LNA and ENA™.

In the "Chemical modification" column of Tables 68 and 69, "point modification" indicates an oligomeric compound having a single modified nucleoside located in the oligomeric compound at any position.

TABLE 68

Antisense oligomeric compounds mimicking mir-143

| ISIS NO: | SEQ ID NO | Chemical modification | Sequence |
|---|---|---|---|
| 348173 | 1864 | Unmodified | GAGCUACAGUGCUUCAUCUCA |
| 348187 | 1864 | Full PS | GsAsGsCsUsAsCsAsGsUsGsCsUsUsCsAsUsCsUsCsA |
| 362972 | 1864 | Alt ribose/2'-MOE | GAeGCeUAeCAeGUeGCeUUeCAeUCeUCeA |
| 366179 | 1864 | Alt ribose/2'-OMe | GAmCmUAmCAmGUmGCmUUmCAmUCmUCmA |
| 366181 | 1864 | Alt 2'-OMe/ribose | GmAGmCUmACmAGmUGmCUmUCmAUmCUmCAm |
| 366182 | 1864 | Full 2'-OMe | GmAmGmCmUmAmCmAmGmUmGmCmUmUmCmAmUmCmUmCmAm |
| 366188 | 1864 | 2'-MOE 3-15-3 gapmer | GeAeGeCUACAGUGCUUCAUCUeCeAe |
| 366189 | 1864 | Full 2'-MOE | GeAeGeCeUeAeCeAeGeUeGeCeUeUeCeAeUeCeUeCeAe |
| 366190 | 1864 | Alt 2'-MOE/ribose | GeAGeCUeACeAGeUGeCUeUCeAUeCUeCAe |
| 366198 | 1864 | Alt 2'-F/2'-OMe | GfAmGfCmUfAmCfAmGfUmGfCmUfUmCfAmUfCmUfCmAf |

TABLE 69

Sense oligomeric compounds mimicking mir-143

| ISIS NO: | SEQ ID NO | Chemical modification | Sequence |
|---|---|---|---|
| 348201 | 1088 | Unmodified | UGAGAUGAAGCACUGUAGCUC |
| 342199 | 220 | Unmodified | UGAGAUGAAGCACUGUAGCUCA |
| 348215 | 1088 | Full PS | UsGsAsGsAsUsGsAsAsGsCsAsCsUsGsUsAsGsCsUsC |
| 366175 | 1088 | PO/PS/PO gapmer | UGAGAUGAAGsCsAsCsUsGUAGCUC |
| 366176 | 1088 | 5' PS hemimer | UsGsAsGsAsUGAAGCACUGUAGCUC |
| 366177 | 1088 | 3' PS hemimer | UGAGAUGAAGCACUGUsAsGsCsUsC |
| 366178 | 1088 | Alt 2'-OMe/ribose | UmGAmGAmUGmAAmGCmACmUGmUAmGCmUCm |
| 366180 | 1088 | Alt ribose/2'-OMe | UGmAGmAUmGAmAGmCAmCUmGUmAGmCUmCm |
| 366183 | 1088 | 2'-OMe blockmer | UGAGAUmGmAAGmCmACUGUAGCmUmCm |
| 366184 | 1088 | 2'-OMe blockmer | UGAGAUGAmAmGCAmCmUGUAGCmUmCm |

TABLE 69-continued

Sense oligomeric compounds mimicking mir-143

| ISIS NO: | SEQ ID NO | Chemical modification | Sequence |
|---|---|---|---|
| 366185 | 1088 | 2'-MOE blockmer | UGAGAUGAAGCAeCeUGUAGCUC |
| 366186 | 1088 | 2'-MOE blockmer | UGAGeAeUeGAAGCACUGUAGCUC |
| 366187 | 1088 | 2'-MOE blockmer | UGAGAUGAAGCACUGUeAeGeCUC |
| 366191 | 1088 | 4' s gapmer | U4sGAGAUGAAGCACUGUAGC4sU4sC4s |
| 366192 | 1088 | 4' s 2'-OMe gapmer | U4sGAGAUGAAGCACUGUAGCmUmCm |
| 366193 | 1088 | 2'-F blockmer | UGfAfGfAfUfGfAfAfGCACUGUAGCUC |
| 366194 | 1088 | LNA blockmer | UGAGlAlUlGAAGCACUGUAGCUC |
| 366195 | 1088 | LNA blockmer | UGAGAUGAAGCACUGUlAlGlCUC |
| 366196 | 1088 | LNA blockmer | UGAGAUGAAGCAlClUGUAGCUC |
| 366197 | 1088 | Alt 2'-OMe/2'-F | UmGfAmGfAmUfGmAfAmGfCmAfCmUfGmUfAmGfCmUfCm |
| 366209 | 1088 | LNA blockmer | UGAGlAlTlGAAGCACUGUAGCUC |
| 366210 | 1088 | LNA blockmer | UGAGAUGAAGCACUGTlAlGlCUC |
| 366211 | 1088 | LNA point modification | UGAGAUGAAGCAl'''ClUGUAGCUC |

Oligomeric compounds representing mimics of the antisense and the sense strands of a double-stranded miRNA can be hybridized, and various combinations of synthetic, modified or unmodified double-stranded oligomeric compounds, each representing a double-stranded miRNA mimic, may be formed. With the various chemical modifications, many permutations of such double-stranded miRNA mimics can be achieved. These double-stranded oligomeric compounds can be blunt-ended or can comprise two strands differing in length such that the resulting double-stranded oligomeric compound has a 3'- and/or a 5'-overhang of one to five nucleotides on either the sense and/or antisense strands. The compounds can be analyzed for their ability to mimic miRNAs, pre-miRNAs, or pri-miRNAs and to bind to nucleic acid targets (for example, RNA transcripts, mRNAs, reporter constructs), for their effects on miRNA, pre-miRNA, or pri-miRNA expression levels by quantitative real-time PCR, or they can be used in other in vivo or in vitro phenotypic assays to investigate the role of miRNAs in regulation of downstream nucleic acid targets, as described in other examples herein. These oligomeric compounds of the present invention may disrupt pri-miRNA and/or pre-miRNA structures, and sterically hinder cleavage by Drosha-like and/or Dicer-like Rnase III enzymes, respectively. Oligomeric compounds capable of binding to the mature miRNA are also predicted to prevent the RISC-mediated binding of a miRNA to its mRNA target, either by cleavage or steric occlusion of the miRNA.

In some embodiments, HeLa cells transiently expressing the pGL3-mir-143 sensor reporter vector and the pRL-CMV *Renilla* luciferase plasmids, as described in Example 27, were also treated with double-stranded oligomeric compounds produced by hybridizing an antisense oligomeric compound from Table 68 with a sense oligomeric compound from Table 69, as described herein. HeLa cells were routinely cultured and passaged and on the day before transfection, the HeLa cells were seeded onto 96-well plates 3,000 cells/well. Cells were transfected according to standard published procedures with plasmids using 2 µg Lipofectamine™ 2000 Reagent (Invitrogen) per µg of plasmid DNA, or, when transfecting double-stranded oligomeric compounds, 1.25 µg of Lipofectamine™ 2000 Reagent was used per 100 nM oligonucleotide. Cells were treated at 10 nM and 100 nM with the double-stranded oligomeric compound mimics. A double-stranded oligomeric compound representing a 10-base mismatched sequence antisense to the unrelated PTP1B mRNA, composed of ISIS Number 342427 (SEQ ID NO: 863) hybridized to its perfect complement ISIS Number 342430 (SEQ ID NO: 864) was used as a negative control ("ds-Control"). The pGL3-mir-143 sensor reporter plasmid was transfected at 0.025 µg per well. The luciferase signal in each well was normalized to the *Renilla* luciferase (RL) activity produced from the co-transfected pRL-CMV plasmid, which was transfected at 2.5 µg per well. In accordance with methods described in Example 12 and 27, a luciferase assay was performed 48-hours after transfection. Briefly, cells were lysed in passive lysis buffer (PLB; Promega), and 20 ul of the lysate was then assayed for RL activity using a Dual Luciferase Assay kit (Promega) according to the manufacturer's protocol. The results below are an average of two trials and are present as percent pGL3-Control luciferase expression normalized to pRL-CMV expression (RL). The data are shown in Table 70.

TABLE 70

Luciferase assays showing effects of double-stranded compounds mimicking mir-143

| ISIS Numbers hybridized to form ds compound | luciferase expression (% lucif. only control) | |
|---|---|---|
| | 10 nM treatment | 100 nM treatment |
| pGL3-mir-143 sensor + pRL-CMV only | 79.4 | 94.1 |
| pGL3-mir-143 sensor + pRL-CMV only | 120.6 | 105.9 |
| 342430 + 342427 ds-Control | 75.0 | 86.1 |
| 348215 + 348173 | 23.1 | 37.5 |
| 348215 + 362972 | 28.6 | 32.4 |
| 366175 + 348173 | 20.0 | 25.0 |
| 366175 + 362972 | 56.9 | 33.4 |
| 366176 + 348173 | 42.6 | 30.0 |
| 366176 + 362972 | 63.4 | 98.5 |
| 366177 + 348173 | 35.7 | 33.6 |
| 366177 + 362972 | 32.8 | 29.1 |
| 366183 + 348173 | 29.2 | 24.5 |
| 366183 + 362972 | 54.3 | 36.8 |
| 366184 + 348173 | 35.6 | 27.7 |
| 366184 + 362972 | 47.3 | 31.9 |
| 366185 + 348173 | 22.2 | 18.5 |
| 366185 + 362972 | 27.2 | 28.7 |
| 366186 + 348173 | 34.8 | 26.8 |
| 366186 + 362972 | 50.2 | 60.8 |
| 366187 + 348173 | 34.6 | 32.4 |
| 366187 + 362972 | 25.5 | 27.9 |
| 366209 + 348173 | 112.9 | 85.4 |
| 366209 + 362972 | 111.3 | 97.5 |
| 366210 + 348173 | 37.1 | 28.2 |
| 366210 + 362972 | 51.8 | 41.1 |
| 366211 + 348173 | 32.1 | 28.7 |
| 366211 + 362972 | 46.6 | 36.7 |
| 366193 + 348173 | 20.0 | 17.6 |
| 366193 + 362972 | 24.4 | 22.6 |
| 366191 + 348173 | 27.3 | 26.9 |
| 366191 + 362972 | 37.5 | 25.8 |
| 366192 + 348173 | 22.3 | 27.9 |
| 366192 + 362972 | 28.9 | 25.7 |
| 366197 + 348173 | 37.0 | 22.2 |
| 366197 + 362972 | 42.0 | 32.7 |
| 366197 + 366198 | 30.2 | 28.7 |
| 366178 + 348173 | 75.0 | 74.0 |
| 366178 + 362972 | 98.6 | 104.0 |
| 366178 + 366179 | 63.5 | 75.4 |
| 366178 + 366181 | 74.1 | 70.6 |
| 366180 + 366179 | 97.0 | 38.5 |
| 366180 + 366181 | 43.5 | 50.2 |
| pGL3-mir-143 sensor + pRL-CMV only | 100.0 | 112.9 |
| 342430 + 342427 ds-Control | 81.2 | 165.9 |
| 348201 + 348187 | 44.0 | 55.4 |
| 348201 + 366182 | 138.9 | 89.2 |
| 348201 + 366179 | 76.2 | 68.5 |
| 348201 + 366181 | 92.2 | 340.0 |
| 348201 + 362972 | 65.2 | 67.3 |
| 348201 + 366198 | 47.3 | 58.8 |
| 342199 + 348173 | 40.3 | 122.0 |
| 342199 + 348187 | 91.3 | 55.5 |
| 342199 + 366182 | 47.4 | 84.1 |
| 342199 + 366179 | 76.5 | 45.9 |
| 342199 + 366181 | 86.1 | 34.2 |
| 342199 + 362972 | 50.8 | 78.7 |
| 342199 + 366189 | 26.7 | 45.2 |
| 342199 + 366190 | 93.0 | 37.9 |
| 342199 + 366198 | 52.5 | 45.5 |

From these data, it was observed that treatment of HeLa cells expressing the pGL3-mir-143 sensor reporter vector with many of the double-stranded oligomeric compounds mimicking mir-143 at both the 10 nM and 100 nM concentrations resulted in inhibition of luciferase activity. For example, the double stranded oligomeric compounds comprising ISIS Number 348173 as an unmodified antisense strand in combination with ISIS Number 366177 (a hemimer with phosphorothioate modified residues at the 3' end) or ISIS Number 366185 (a 2'-MOE blockmer) as the modified sense strand resulted in significant reductions in luciferase activity. Furthermore, double stranded oligomeric compounds comprising, as the antisense strand, either ISIS Number 366189 (a fully modified 2'-MOE compound) or ISIS Number 366198 (with alternating 2'-Fluoro and 2'-O-Methyl residues), in combination with ISIS Number 342199 as the unmodified sense strand resulted in significant reductions in luciferase activity, indicating that these compounds are effective mir-143 mimics. Taken with the previous observations that the mir-143 miRNA is involved in adipocyte differentiation, these double-stranded mir-143 mimics may be useful as therapeutic agents with applications in the treatment, attenuation or prevention of obesity, hyperlipidemia, atherosclerosis, atherogenesis, diabetes, hypertension, or other metabolic diseases as well as having potential applications in the maintenance of the pluripotent phenotype of stem or precursor cells.

Example 38

Design of Oligomeric Compounds Targeting pri-miRNAs

As described above, mature miRNAs originate from pri-miRNAs, which are believed to be processed into pre-miRNAs by the Drosha RNase III enzyme, and subsequently exported from the nucleus to the cytoplasm, where the pre-miRNAs are processed by human Dicer into double-stranded intermediates resembling siRNAs, which are then processed into mature miRNAs.

Some oligomeric compounds of the present invention are believed to bind to pri-miRNA molecules and interfere with their processing into a mature miRNA. These oligomeric compounds were observed to affect a decrease in expression levels of mature miRNA, presumably due, at least in part, to steric interference with their processing into mature miRNAs by human Dicer. Furthermore, as described above, some oligomeric compounds of the present invention have been observed to affect an increase in expression levels of pri-miRNAs; it is believed that the decrease in levels of mature miRNAs cells treated with these oligomeric compounds may trigger a feedback mechanism that signals these cells to increase production of the pri-miRNA molecule. This increase may be the result, at least in part, of a stimulation of transcription of the pri-miRNAs in response to the decrease in mature miRNAs. Not mutually exclusive with the processing interference and the feedback mechanisms is the possibility that treatment with oligomeric compounds could stimulate the activity of an RNA-dependent RNA polymerase (RdRP) that amplifies pre-miRNAs or pri-miRNAs.

In one embodiment, several nested series of single-stranded oligomeric compounds, 15-nucleotides in length, composed of 2'-methoxyethoxy (2'-MOE) modified nucleotides and phosphorothioate (P=S) internucleoside linkages throughout the compound, were designed and synthesized to target several pri-miRNAs, to test the effects of these compounds on the expression levels of small non-coding RNAs. These compounds are shown in Table 71, below. "Pri-miRNA" indicates the particular pri-miRNA which contains the miRNA that the oligomeric compound was designed to target. The "Region" column describes the general region of the pri-miRNA that is being targeted. The following features of the stemloop structures of pri-miRNA were targeted: 1) "5'-stem side mir start" means the 5'-stem side at the 5'-end of the sequence representing the mature miRNA, with the oligomeric compounds targeting and spanning sequences completely outside of the mature miRNA to completely within it; 2) "5'-stem side mir end" means the 5'-stem side at the 3'-end of the sequence representing the mature miRNA, with the oligomeric compounds targeting and spanning sequences completely within the mature miRNA to spanning and extending beyond the 3'-end of it; 3) "loop start" means the 5'-side of the loop region; 4) "loop end" means with the oligomeric compounds targeting and ending at the 3'-side of the loop region; 5) "3'-stem side mir start" means the 3'-stem side at the 5'-end of the sequence representing the mature miRNA, with the oligomeric compounds targeting and completely within the mature miRNA to a few nucleotides outside of it; 6) "3'-stem side mir end" means the 3'-stem side at the 3'-end of the sequence representing the mature miRNA, with the oligomeric compounds targeting and spanning sequences completely within the mature miRNA to completely outside of it.

TABLE 71

Uniform 2'-MOE oligomeric compounds targeting pri-miRNAs

| pri-miRNA | Region | Isis # | Sequence | SEQ ID NO: |
|---|---|---|---|---|
| mir-182 | mir-182 5'-stem side mir start | 366888 | AAACGGGGGAGGCA | 1997 |
| mir-182 | mir-182 5'-stem side mir start | 366889 | GCCAAAAACGGGGG | 1998 |
| mir-182 | mir-182 5'-stem side mir start | 366890 | ATTGCCAAAAACGGG | 1999 |
| mir-182 | mir-182 5'-stem side mir start | 366891 | ACCATTGCCAAAAAC | 2000 |
| mir-182 | mir-182 5'-stem side mir start | 366892 | TCTACCATTGCCAAA | 2001 |
| mir-182 | mir-182 5'-stem side mir end | 366893 | TGTGAGTTCTACCAT | 2002 |
| mir-182 | mir-182 5'-stem side mir end | 366894 | CAGTGTGAGTTCTAC | 2003 |
| mir-182 | mir-182 5'-stem side mir end | 366895 | CACCAGTGTGAGTTC | 2004 |
| mir-182 | mir-182 5'-stem side mir end | 366896 | CCTCACCAGTGTGAG | 2005 |
| mir-182 | mir-182 loop start | 366897 | TCCTGTTACCTCACC | 2006 |
| mir-182 | mir-182 loop start | 366898 | GATCCTGTTACCTCA | 2007 |
| mir-182 | mir-182 loop start | 366899 | CGGATCCTGTTACCT | 2008 |
| mir-182 | mir-182 loop end | 366900 | TGTTACCTCAGCAGT | 2009 |
| mir-182 | mir-182 loop end | 366901 | CCTGTTACCTCACCA | 2010 |
| mir-182 | mir-182 loop end | 366902 | ATCCTGTTACCTCAC | 2011 |
| mir-182 | mir-182 loop end | 366903 | GGATGCTGTTACCTC | 2012 |
| mir-182 | mir-182 loop end | 366904 | CCGGATCCTGTTACC | 2013 |
| mir-182 | mir-182 3'-stem side mir start | 366905 | GAACCACCGGATCCT | 2014 |
| mir-182 | mir-182 3'-stem side mir start | 366906 | CTAGAACCACCGGAT | 2015 |
| mir-182 | mir-182 3'-stem side mir start | 366907 | AGTCTAGAACCACCG | 2016 |
| mir-182 | mir-182 3'-stem side mir start | 366908 | GCAAGTCTAGAACCA | 2017 |
| mir-182 | mir-182 3'-stem side mir end | 366909 | ATAGTTGGCAAGTCT | 2018 |
| mir-182 | mir-182 3'-stem side mir end | 366910 | CGCCCATAGTTGGC | 2019 |
| mir-182 | mir-182 3'-stem side mir end | 366911 | CCTCGCCCCATAGTT | 2020 |
| mir-182 | mir-182 3'-stem side mir end | 366912 | AGTCCTCGCCCCATA | 2021 |
| mir-182 | mir-182 3'-stem side mir end | 366913 | CTGAGTCCTCGCCCC | 2022 |
| mir-216 | mir-216 5'-stem side mir start | 366914 | AAGCCAACTGACAGC | 2023 |
| mir-216 | mir-216 5'-stem side mir start | 366915 | AGATTAAGCCAACTC | 2024 |
| mir-216 | mir-216 5'-stem side mir start | 366916 | CTGAGATTAAGCCAA | 2025 |

TABLE 71-continued

Uniform 2'-MOE oligomeric compounds targeting pri-miRNAs

| pri-miRNA | Region | Isis # | Sequence | SEQ ID NO: |
|---|---|---|---|---|
| mir-216 | mir-216 5'-stem side mir start | 366917 | CAGCTGAGATTAAGC | 2026 |
| mir-216 | mir-216 5'-stem side mir start | 366918 | TGCCAGCTGAGATTA | 2027 |
| mir-216 | mir-216 5'-stem side mir end | 366919 | TCACAGTTGCCAGCT | 2028 |
| mir-216 | mir-216 5'-stem side mir end | 366920 | ATCTCACAGTTGCCA | 2029 |
| mir-216 | mir-216 5'-stem side mir end | 366921 | AACATGTCACAGTTG | 2030 |
| mir-216 | mir-216 5'-stem side mir end | 366922 | ATGAACATCTCACAG | 2031 |
| mir-216 | mir-216 loop start | 366923 | ATTGTATGAACATCT | 2032 |
| mir-216 | mir-216 loop start | 366924 | GGATTGTATGAACAT | 2033 |
| mir-216 | mir-216 loop start | 366925 | AGGGATTGTATGAAC | 2034 |
| mir-216 | mir-216 loop end | 366926 | TGTATGAACATCTCA | 2035 |
| mir-216 | mir-216 loop end | 366927 | TGAGGGATTGTATGA | 2036 |
| mir-216 | mir-216 3'-stem side mir start | 366928 | ACTGTGAGGGATTGT | 2037 |
| mir-216 | mir-216 3'-stem side mir start | 366929 | ACCACTGTGAGGGAT | 2038 |
| mir-216 | mir-216 3'-stem side mir start | 366930 | GAGACCACTGTGAGG | 2039 |
| mir-216 | mir-216 3'-stem side mir start | 366931 | CCAGAGACCACTGTG | 2040 |
| mir-216 | mir-216 3'-stem side mir end | 366932 | CATAATCCCAGAGAC | 2041 |
| mir-216 | mir-216 3'-stem side mir end | 366933 | GTTTAGCATAATCCC | 2042 |
| mir-216 | mir-216 3'-stem side mir end | 366934 | TCTGTTTAGCATAAT | 2043 |
| mir-216 | mir-216 3'-stem side mir end | 366935 | TGCTCTGTTTAGCAT | 2044 |
| mir-216 | mir-216 3'-stem side mir end | 366936 | AATTGCTCTGTTTAG | 2045 |
| mir-143 | mir-143 5'-stem side mir start | 366937 | AGGCTGGGAGACAGG | 2046 |
| mir-143 | mir-143 5'-stem side mir start | 366938 | ACCTCAGGCTGGGAG | 2047 |
| mir-143 | mir-143 5'-stem side mir start | 366939 | TGCACCTCAGGCTGG | 2048 |
| mir-143 | mir-143 5'-stem side mir start | 366940 | CACTGCACCTCAGGC | 2049 |
| mir-143 | mir-143 5'-stem side mir start | 366941 | CAGCACTGCACCTCA | 2050 |
| mir-143 | mir-143 5'-stem side mir end | 366942 | AGAGATGCAGCACTG | 2051 |
| mir-143 | mir-143 5'-stem side mir end | 366943 | ACCAGAGATGCAGCA | 2052 |
| mir-143 | mir-143 5'-stem side mir end | 366944 | CTGACCAGAGATGCA | 2053 |
| mir-143 | mir-143 5'-stem side mir end | 366945 | CAACTGACCAGAGAT | 2054 |
| mir-143 | mir-143 loop start | 366946 | CAGACTCCGAACTGA | 2055 |
| mir-143 | mir-143 loop start | 366947 | CTCAGACTCCCAACT | 2056 |
| mir-143 | mir-143 loop start | 366948 | ATCTCAGACTCCCAA | 2057 |
| mir-143 | mir-143 loop end | 366949 | AACTGACCAGAGATG | 2058 |
| mir-143 | mir-143 loop end | 366950 | CCAACTGACCAGAGA | 2059 |
| mir-143 | mir-143 loop end | 366951 | TCCCAACTGACCAGA | 2060 |
| mir-143 | mir-143 loop end | 366952 | ACTCCCAACTGACCA | 2061 |
| mir-143 | mir-143 3'-stem side mir start | 366953 | TTCATCTCAGACTCC | 2062 |

TABLE 71-continued

Uniform 2'-MOE oligomeric compounds targeting pri-miRNAs

| pri-miRNA | Region | Isis # | Sequence | SEQ ID NO: |
|---|---|---|---|---|
| mir-143 | mir-143 3'-stem side mir start | 366954 | TGCTTCATCTCAGAC | 2063 |
| mir-143 | mir-143 3'-stem side mir start | 366955 | CAGTGCTTCATCTCA | 2064 |
| mir-143 | mir-143 3'-stem side mir end | 366956 | TGAGCTACAGTGCTT | 2065 |
| mir-143 | mir-143 3'-stem side mir end | 366957 | TCTTCCTGAGCTACA | 2066 |
| mir-143 | mir-143 3'-stem side mir end | 366958 | CTCTCTTCCTGAGCT | 2067 |
| mir-143 | mir-143 3'-stem side mir end | 366959 | CTTCTCTCTTCCTGA | 2068 |
| mir-143 | mir-143 3'-stem side mir end | 366960 | CAACTTCTCTCTTCC | 2069 |
| mir-23b | mir-23b 5'-stem side mir start | 366961 | AGCAGCCAGAGCACC | 2070 |
| mir-23b | mir-23b 5'-stem side mir start | 366962 | ACCCAAGCAGCCAGA | 2071 |
| mir-23b | mir-23b 5'-stem side mir start | 366963 | GGAACCCAAGCAGCC | 2072 |
| mir-23b | mir-23b 5'-stem side mir start | 366964 | CCAGGAACCCAAGCA | 2073 |
| mir-23b | mir-23b 5'-stem side mir start | 366965 | ATGCCAGGAACCCAA | 2074 |
| mir-23b | mir-23b 5'-stem side mir end | 366966 | AATCAGCATGCCAGG | 2075 |
| mir-23b | mir-23b 5'-stem side mir end | 366967 | ACAAATCAGCATGCC | 2076 |
| mir-23b | mir-23b 5'-stem side mir end | 366968 | GTCACAAATGAGCAT | 2077 |
| mir-23b | mir-23b 5'-stem side mir end | 366969 | TAAGTCACAAATCAG | 2078 |
| mir-23b | mir-23b loop start | 366970 | AATCTTAAGTCACAA | 2079 |
| mir-23b | mir-23b loop start | 366971 | TTAATCTTAAGTCAC | 2080 |
| mir-23b | mir-23b loop start | 366972 | TTTTAATCTTAAGTC | 2081 |
| mir-23b | mir-23b loop end | 366973 | CTTAAGTCACAAATC | 2082 |
| mir-23b | mir-23b loop end | 366974 | ATCTTAAGTCACAAA | 2083 |
| mir-23b | mir-23b loop end | 366975 | TAATCTTAAGTCACA | 2084 |
| mir-23b | mir-23b loop end | 366976 | TTTAATCTTAAGTCA | 2085 |
| mir-23b | mir-23b loop end | 366977 | ATTTTAATCTTAAGT | 2086 |
| mir-23b | mir-23b 3'-stem side mir start | 366978 | TGTGATTTTAATCTT | 2087 |
| mir-23b | mir-23b 3'-stem side mir start | 366979 | CAATGTGATTTTAAT | 2088 |
| mir-23b | mir-23b 3'-stem side mir start | 366980 | TGGCAATGTGATTTT | 2089 |
| mir-23b | mir-23b 3'-stem side mir start | 366981 | CCGTGGCAATGTGAT | 2090 |
| mir-23b | mir-23b 3'-stem side mir end | 366982 | TGGTAATCCCTGGCA | 2091 |
| mir-23b | mir-23b 3'-stem side mir end | 366983 | GTTGCGTGGTAATCC | 2092 |
| mir-23b | mir-23b 3'-stem side mir end | 366984 | GTGGTTGCGTGGTAA | 2093 |
| mir-23b | mir-23b 3'-stem side mir end | 366985 | GTCGTGGTTGCGTGG | 2094 |
| mir-23b | mir-23b 3'-stem side mir end | 366986 | AAGGTCGTGGTTGCG | 2095 |
| mir-203 | mir-203 5'-stem side mir start | 366987 | GACCCAGCGCGCGAG | 2096 |
| mir-203 | mir-203 5'-stem side mir start | 366988 | CAGTGGACCCAGCGC | 2097 |
| mir-203 | mir-203 5'-stem side mir start | 366989 | AACCACTGGACCCAG | 2098 |

TABLE 71-continued

Uniform 2'-MOE oligomeric compounds targeting pri-miRNAs

| pri-miRNA | Region | Isis # | Sequence | SEQ ID NO: |
|---|---|---|---|---|
| mir-203 | mir-203 5'-stem side mir start | 366990 | AAGAACCACTGGACC | 2099 |
| mir-203 | mir-203 5'-stem side mir start | 366991 | GTTAAGAACCACTGG | 2100 |
| mir-203 | mir-203 5'-stem side mir end | 366992 | TTGAACTGTTAAGAA | 2101 |
| mir-203 | mir-203 5'-stem side mir end | 366993 | CTGTTGAACTGTTAA | 2102 |
| mir-203 | mir-203 5'-stem side mir end | 366994 | GAACTGTTGAACTGT | 2103 |
| mir-203 | mir-203 5'-stem side mir end | 366995 | ACAGAACTGTTGAAC | 2104 |
| mir-203 | mir-203 loop start | 366996 | AATTGCGCTACAGAA | 2105 |
| mir-203 | mir-203 loop start | 366997 | ACAATTGCGCTACAG | 2106 |
| mir-203 | mir-203 loop start | 366998 | TCACAATTGCGCTAC | 2107 |
| mir-203 | mir-203 loop end | 366999 | TACAGAACTGTTGAA | 2108 |
| mir-203 | mir-203 loop end | 367000 | GCTACAGAACTGTTG | 2109 |
| mir-203 | mir-203 loop end | 367001 | GCGCTACAGAACTGT | 2110 |
| mir-203 | mir-203 loop end | 367002 | TTGCGCTACAGAACT | 2111 |
| mir-203 | mir-203 3'-stem side mir start | 367003 | TTTCACAATTGCGCT | 2112 |
| mir-203 | mir-203 3'-stem side mir start | 367004 | ACATTTCACAATTGC | 2113 |
| mir-203 | mir-203 3'-stem side mir start | 367005 | TAAACATTTCACAAT | 2114 |
| mir-203 | mir-203 3'-stem side mir start | 367006 | TCCTAAACATTTCAC | 2115 |
| mir-203 | mir-203 3'-stem side mir end | 367007 | CTAGTGGTCCTAAAC | 2116 |
| mir-203 | mir-203 3'-stem side mir end | 367008 | CCGGGTCTAGTGGTC | 2117 |
| mir-203 | mir-203 3'-stem side mir end | 367009 | CCGCCGGGTCTAGTG | 2118 |
| mir-203 | mir-203 3'-stem side mir end | 367010 | CGCCCGCCGGGTCTA | 2119 |
| mir-203 | mir-203 3'-stem side mir end | 367011 | CCGCGCCCGCCGGGT | 2120 |
| mir-21 | mir-21 5'-stem side mir start | 367012 | GCTACCCGACAAGGT | 2121 |
| mir-21 | mir-21 5'-stem side mir start | 367013 | AAGCTACCCGACAAG | 2122 |
| mir-21 | mir-21 5'-stem side mir start | 367014 | GATAAGCTACCCGAC | 2123 |
| mir-21 | mir-21 5'-stem side mir start | 367015 | TCTGATAAGCTACCC | 2124 |
| mir-21 | mir-21 5'-stem side mir start | 367016 | CAGTCTGATAAGCTA | 2125 |
| mir-21 | mir-21 5'-stem side mir end | 367017 | TCAACATCAGTCTGA | 2126 |
| mir-21 | mir-21 5'-stem side mir end | 367018 | CAGTCAACATCAGTC | 2127 |
| mir-21 | mir-21 5'-stem side mir end | 367019 | CAACAGTCAACATCA | 2128 |
| mir-21 | mir-21 5'-stem side mir end | 367020 | ATTCAACAGTCAACA | 2129 |
| mir-21 | mir-21 loop start | 367021 | GCCATGAGATTCAAC | 2130 |
| mir-21 | mir-21 loop start | 367022 | TTGCCATGAGATTCA | 2131 |
| mir-21 | mir-21 loop start | 367023 | TGTTGCCATGAGATT | 2132 |
| mir-21 | mir-21 loop end | 367024 | TTCAACAGTCAACAT | 2133 |
| mir-21 | mir-21 loop end | 367025 | GATTCAACAGTCAAC | 2134 |
| mir-21 | mir-21 loop end | 367026 | GAGATTCAACAGTCA | 2135 |

TABLE 71-continued

Uniform 2'-MOE oligomeric compounds targeting pri-miRNAs

| pri-miRNA | Region | Isis # | Sequence | SEQ ID NO: |
|---|---|---|---|---|
| mir-21 | mir-21 loop end | 367027 | ATGAGATTCAACAGT | 2136 |
| mir-21 | mir-21 loop end | 367028 | GCATGAGATTCAACA | 2137 |
| mir-21 | mir-21 3'-stem side mir start | 367029 | GTGTTGCCATGAGAT | 2138 |
| mir-21 | mir-21 3'-stem side mir start | 367030 | CTGGTGTTGCCATGA | 2139 |
| mir-21 | mir-21 3'-stem side mir start | 367031 | CGACTGGTGTTGCCA | 2140 |
| mir-21 | mir-21 3'-stem side mir start | 367032 | CATCGACTGGTGTTG | 2141 |
| mir-21 | mir-21 3'-stem side mir end | 367033 | GACAGCCCATCGACT | 2142 |
| mir-21 | mir-21 3'-stem side mir end | 367034 | ATGTCAGACAGCCCA | 2143 |
| mir-21 | mir-21 3'-stem side mir end | 367035 | AAATGTCAGACAGCC | 2144 |
| mir-21 | mir-21 3'-stem side mir end | 367036 | CAAAATGTCAGACAG | 2145 |
| mir-221 | mir-221 5'-stem side mir start | 367037 | CATGCCCCAGACCTG | 2146 |
| mir-221 | mir-221 5'-stem side mir start | 367038 | AGGTTCATGCCCCAG | 2147 |
| mir-221 | mir-221 5'-stem side mir start | 367039 | GCCAGGTTCATGCCC | 2148 |
| mir-221 | mir-221 5'-stem side mir start | 367040 | TATGCCAGGTTCATG | 2149 |
| mir-221 | mir-221 5'-stem side mir start | 367041 | TTGTATGCCAGGTTC | 2150 |
| mir-221 | mir-221 5'-stem side mir end | 367042 | ATCTACATTGTATGC | 2151 |
| mir-221 | mir-221 5'-stem side mir end | 367043 | GAAATCTACATTGTA | 2152 |
| mir-221 | mir-221 5'-stem side mir end | 367044 | ACAGAAATCTACATT | 2153 |
| mir-221 | mir-221 5'-stem side mir end | 367045 | AACACAGAAATCTAC | 2154 |
| mir-221 | mir-221 loop start | 367046 | CTGTTGCCTAACGAA | 2155 |
| mir-221 | mir-221 loop start | 367047 | AGCTGTTGCCTAACG | 2156 |
| mir-221 | mir-221 loop start | 367048 | GTAGCTGTTGCCTAA | 2157 |
| mir-221 | mir-221 loop end | 367049 | GAACACAGAAATCTA | 2158 |
| mir-221 | mir-221 loop end | 367050 | ACGAACACAGAAATC | 2159 |
| mir-221 | mir-221 loop end | 367051 | TAACGAACACAGAAA | 2160 |
| mir-221 | mir-221 loop end | 367052 | CCTAACGAACACAGA | 2161 |
| mir-221 | mir-221 loop end | 367053 | TGCCTAACGAACACA | 2162 |
| mir-221 | mir-221 3'-stem side mir start | 367054 | AATGTAGCTGTTGCC | 2163 |
| mir-221 | mir-221 3'-stem side mir start | 367055 | GACAATGTAGCTGTT | 2164 |
| mir-221 | mir-221 3'-stem side mir start | 367056 | GCAGACAATGTAGCT | 2165 |
| mir-221 | mir-221 3'-stem side mir end | 367057 | AAACCCAGCAGACAA | 2166 |
| mir-221 | mir-221 3'-stem side mir end | 367058 | AGCCTGAAACCCAGC | 2167 |
| mir-221 | mir-221 3'-stem side mir end | 367059 | GGTAGCCTGAAACCC | 2168 |
| mir-221 | mir-221 3'-stem side mir end | 367060 | CCAGGTAGCCTGAAA | 2169 |
| mir-221 | mir-221 3'-stem side mir end | 367061 | TTTCCAGGTAGCCTG | 2170 |

These modified oligomeric compounds targeting pri-miR-NAs can be transfected into preadipocytes or other undifferentiated cells, which are then induced to differentiate, and it can be determined whether these modified oligomeric compounds act to inhibit or promote cellular differentiation. These compounds can be transfected into differentiating adipocytes and their effects on expression levels of the pri-miRNA molecules assessed in pre-adipocytes vs. differentiated adipocytes. By using a primer/probe set specific for the pri-miRNA or the pre-miRNA, real-time RT-PCR methods can be used to determine whether modified oligomeric compounds targeting pri-miRNAs can affect the expression or processing of the mature miRNAs from the pri-miRNA or pre-miRNA molecules.

Example 39

Effects of Oligomeric Compounds Targeting miRNAs in the Immune Response

To investigate the role of miRNAs in the immune response, oligomeric compounds of the present invention targeting miRNAs were tested for their effects upon lipopolysaccharide (LPS)-activated primary murine macrophages. Macrophages participate in the immune response, for example, in the recognition and phagocytosis of microorganisms, including bacteria. Interferon-gamma (IFN-gamma) released by helper T cells is one type of signal required for macrophage activation, and LPS can serve as an additional stimulus. LPS is a component of the gram-negative bacterial cell wall and acts as an agonist for toll-like receptor 4 (TLR4), the primary LPS receptor expressed by macrophages. The proinflammatory cytokines interleukin-12 (IL-12) and interleukin-6 (IL-6) are induced by LPS treatment of macrophages, thus the expression of the mRNAs encoding these cytokines was used to evaluate the response of macrophages to LPS following treatment with oligomeric compounds targeting miRNAs.

Macrophages were isolated as follows. Female C57B1/6 mice (Charles River Laboratories, Wilmington, Mass.) were injected intraperitoneally with 1 ml 3% thioglycollate broth (Sigma-Aldrich, St. Louis, Mo.), and peritoneal macrophage cells were isolated by peritoneal lavage 4 days later. The cells were plated in 96-well plates at 40,000 cells/well for one hour in serum-free RPMI adjusted to contain 10 mM HEPES (Invitrogen Life Technologies, Carlsbad, Calif.), allowed to adhere, then non-adherent cells were washed away and the media was replaced with RPMI containing 10 mM HEPES, 10% FBS and penicillin/streptomycin ("complete" RPMI; Invitrogen Life Technologies, Carlsbad, Calif.).

Oligomeric compounds were introduced into the cells using the non-liposomal transfection reagent FuGENE 6 Transfection Reagent (Roche Diagnostics Corp., Indianapolis, Ind.). Oligomeric compound was mixed with FuGENE 6 in 1 mL of serum-free RPMI to achieve a concentration of 10 µL FuGENE per 1000 nM oligomeric compound. The oligomeric compound/FuGENE complex was allowed to form at room temperature for 20 minutes. This mixture was diluted to the desired concentration of oligomeric compound by the addition of the appropriate volume of complete RPMI. The final ratio of FuGENE 6 to oligomeric compound was 1 µL of FuGENE 6 per 100 nM oligomeric compound. A volume of 100 µL of oligomeric compound/FuGENE/RPMI was added to each well of the 96-well plate in which the macrophages were cultured. Each oligomeric compound treatment was repeated in triplicate.

Following oligomeric compound treatment, cells were stimulated with LPS. Cells were cultured in the presence of the transfection complex for approximately 24 to 28 hours at 37° C. and 5% $CO_2$, after which the medium containing the transfection complex was removed from the cells, and complete RPMI containing 100 ng/mL LPS (Sigma-Aldrich Corp., St. Louis, Mo.) was added to the cells for a period of approximately 24 hours. Control samples included (1) cells receiving no oligomeric compound, stimulated with LPS and (2) cells receiving neither oligomeric compound nor LPS treatment.

In another embodiment, following oligomeric compound treatment, cells were first activated by IFN-gamma, to amplify the response to LPS. Cells were cultured in the presence of the transfection complex for approximately 24 hours at 37° C. and 5% $CO_2$, at which point the medium containing the transfection complex was removed from the cells, and complete RPMI containing 100 ng/mL recombinant mouse IFN-gamma (R&D Systems, Minneapolis, Minn.) was added to the cells. After the 4 hour treatment with INF-gamma, cells were treated with 100 ng/mL LPS for approximately 24 hours. Control samples included (1) cells receiving no oligomeric compound, stimulated with LPS and (2) cells receiving neither oligomeric compound nor LPS treatment.

Oligomeric compounds used as negative controls included ISIS 129690 (SEQ ID NO: 907), a universal scrambled control; ISIS 342673 (SEQ ID NO: 758), an oligomeric compound containing 15 mismatches with respect to the mature mir-143 miRNA; ISIS 342683 (SEQ ID NO: 790), an oligomeric compound representing the scrambled nucleotide sequence of an unrelated PTP1B antisense oligonucleotide; and ISIS 289606 (CCTTCCCTGAAGGTTCCTCC, incorporated herein as SEQ ID NO: 863), an oligomeric compound representing the scrambled nucleotide sequence of an unrelated PTP1B antisense oligonucleotide. ISIS 289606 is uniformly composed of 2'-MOE nucleotides, with phosphorothioate internucleoside linkages throughout the compound. All cytidines are 5-methyl cytidines. Used as a positive control was ISIS 229927 (CCACATTGAGTTTCTTTAAG, incorporated herein as SEQ ID NO: 2171), targeting the mouse toll-like receptor 4 (TLR4) mRNA, which is the primary LPS receptor on macrophages. ISIS 229927 is a chimeric oligomeric compound ("gapmer") composed of a central "gap" region consisting of ten 2'-deoxynucleotides, which is flanked on both sides (5' and 3' directions) by five nucleotide "wings," wherein the wings are composed of 2'-methoxyethoxy (2'-MOE) nucleotides. Internucleoside linkages are phosphorothioate throughout the compound, and all cytidines are 5-methylcytidines. Treatments with control oligomeric compounds were performed as described for oligomeric compounds targeting miRNAs.

Following the 24 hour treatment with LPS, the cells were lysed and RNA was isolated using the RNEASY 96™ kit, as described herein. mRNA expression was quantitated by real-time PCR, performed as described herein, using primer and probe sets to amplify and quantitate TLR4, IL-12 and IL-6 mRNA expression levels. Primers and probe for TLR4, designed using GenBank Accession number NM_021297.1, were: forward primer, 5'-CATGGAACACATGGCT-GCTAA-3' (SEQ ID NO: 2172), reverse primer, 5'-GGAAAGGAAGGTGTCAGTGCTACT-3' (SEQ ID NO: 2173), probe 5'-FAM-TAGCATGGACCTTACCGGGCA-GAAGG-TAMRA-3' (SEQ ID NO: 2174). Primers and probe for IL-12, designed using GenBank Accession number M86671.1, were: forward primer, 5'-GCCAGTACACCTGC-CACAAA -3' (SEQ ID NO: 2175), reverse primer, 5'-GAC-CAAATTCCATTTTCCTTCTTG-3' (SEQ ID NO: 2176), probe 5'-FAM-AGGCGAGACTCTGAGCCACTCA-CATCTG-TAMRA-3' (SEQ ID NO: 2177). Primers and probe for IL-6, designed using GenBank Accession number X54542.1, were: forward primer, 5'-CCTAGTGCGTTAT-GCCTAAGCA-3' (SEQ ID NO: 2178), reverse primer, 5'-TTCGTAGAGAACAACATAAGTCAGATACC-3' (SEQ ID NO: 2179), probe 5'-FAM-TTTCTGACCACAGTGAG-GAATGTCCACAA-TAMRA-3' (SEQ ID NO: 2180). The amount of total RNA in each sample was determined using a Ribogreen Assay (Molecular Probes, Eugene, Oreg.), and expression levels of TLR4, IL-12 and IL-6 were normalized to total RNA.

TLR4 is the primary macrophage receptor for LPS. Thus, ISIS Number 229927, targeted to TLR4, was tested for its ability to inhibit TLR4 expression and interfere with the response of macrophages to LPS, both with and without pretreatment with IFN-gamma. The treatment of primary murine macrophages with ISIS Number 229927 at reduced the expression of TLR4 in a dose-dependent manner, in both LPS-stimulated and LPS- and IFN-gamma-stimulated cells. As judged by the dose-dependent reduction in IL-12, the response of macrophages to LPS was reduced following inhibition of the TLR4 receptor expression, in both LPS-stimulated and LPS- and IFN-gamma-stimulated cells. These results demonstrated that ISIS 229927 can be used as a positive control for the inhibition of IL-12 expression in macrophages responding to LPS.

Primary mouse macrophages were treated with a selected group of oligomeric compounds targeting various miRNAs. These compounds and their miRNA targets are shown in Table 72. Table 72 shows IL-12 mRNA expression following treatment with 300 nM of oligomeric compounds and LPS (–IFN), and IL-12 mRNA expression following treatment with 300 nM of oligomeric compounds and stimulation with IFN-gamma and LPS (+IFN). The "–IFN" data represents a single experiment, and the "+IFN" data represents the average of 2 experiments. Data were normalized to values from cells receiving no oligomeric compound that were treated with LPS. IL-12 expression in cells receiving neither oligomeric compound nor LPS treatment was 2% of the control, both with and without IFN-gamma pretreatment, demonstrating that IL-12 mRNA expression was not stimulated in the absence of LPS treatment. Where present, "N.D." indicates "not determined".

TABLE 72

IL-12 mRNA expression in primary macrophages treated with oligomeric compounds targeting miRNAs and stimulated with LPS

| ISIS NO: | SEQ ID NO: | pri-miRNA | –IFN % UTC | +IFN % UTC |
|---|---|---|---|---|
| 289606 | 863 | Scrambled control | N.D. | 129 |
| 342673 | 758 | mismatch to mir-143 | 91 | N.D. |
| 129690 | 907 | Universal control | 73 | 129 |
| 229927 | 2171 | TLR4 | 92 | 145 |
| 327874 | 292 | mir-30a | 202 | 15 |
| 327876 | 294 | mir-29b-1 | 194 | 9 |
| 327883 | 301 | mir-27b | 266 | 39 |
| 327887 | 305 | mir-132 | 287 | 33 |
| 327889 | 307 | mir-23b | 153 | 10 |
| 327890 | 308 | let-7i | 183 | 94 |
| 327893 | 311 | let-7b | 117 | 52 |
| 327899 | 317 | mir-183 | 164 | 7 |
| 327901 | 319 | mir-143 | 225 | 9 |
| 327903 | 321 | let-7a-3 | 200 | 23 |
| 327912 | 330 | let-7f-1 | 206 | 39 |
| 327913 | 331 | mir-29c | 276 | 73 |
| 327917 | 335 | mir-21 | 225 | 35 |
| 327919 | 337 | mir-221 | 179 | 37 |
| 327920 | 338 | mir-222 | 171 | 68 |
| 327921 | 339 | mir-30d | 325 | 24 |
| 327923 | 341 | mir-128b | 269 | 134 |
| 327924 | 342 | mir-129-2 | 171 | 88 |
| 327925 | 343 | mir-133b | 302 | 60 |
| 327927 | 345 | mir-15b | 164 | 33 |
| 327928 | 346 | mir-29a-1 | 201 | 61 |
| 327931 | 349 | let-7c | 105 | 48 |
| 327935 | 353 | mir-20 | 254 | 24 |
| 327936 | 354 | mir-133a-1 | 221 | 55 |
| 327940 | 358 | mir-199a-2 | 228 | 107 |
| 327941 | 359 | mir-181b | 89 | 34 |
| 327945 | 363 | mir-24-2 | 202 | 68 |
| 327956 | 374 | mir-216 | 212 | 59 |
| 327958 | 376 | mir-187 | 188 | 60 |
| 327959 | 377 | mir-210 | 183 | 20 |
| 327961 | 379 | mir-223 | 203 | 10 |
| 327963 | 381 | mir-26b | 224 | 23 |
| 327967 | 385 | let-7g | 203 | 43 |
| 327971 | 389 | mir-23a | 146 | 17 |
| 328105 | 407 | hypothetical miRNA-088 | 108 | 57 |
| 328110 | 412 | hypothetical miRNA-107 | 221 | 8 |
| 328117 | 419 | hypothetical miRNA-144 | 162 | 72 |
| 328123 | 425 | hypothetical miRNA-166 | 176 | 14 |
| 328129 | 431 | hypothetical miRNA-173 | 87 | 10 |
| 328133 | 435 | hypothetical miRNA-178 | 165 | 62 |
| 328137 | 439 | hypothetical miRNA-183 | 213 | 12 |
| 328138 | 440 | hypothetical miRNA-185 | 277 | 31 |
| 340341 | 236 | mir-104 (Mourelatos) | 139 | 13 |
| 340345 | 1882 | miR-27 (Mourelatos) | 104 | 78 |
| 341786 | 1845 | miR-149 | 266 | 99 |
| 341790 | 1843 | miR-154 | 318 | 84 |
| 341793 | 1836 | miR-142-as | 202 | 147 |
| 341800 | 1766 | miR-186 | 180 | 100 |
| 341811 | 1906 | miR-194 | 154 | 88 |
| 341815 | 1831 | miR-200a | 190 | 157 |

A comparison of the data from IFN-gamma-stimulated and unstimulated cells reveals that many of the oligomeric compounds targeting miRNAs attenuated the response of macrophages to LPS, as judged by IL-12 mRNA expression, when the cells were activated with IFN-gamma prior to LPS treatment. When macrophages were pretreated with IFN-gamma, treatment with several of the oligomeric compounds, such as ISIS Number 328110, ISIS Number 32901, ISIS Number 327899, ISIS Number 327876 and ISIS Number 327961 resulted in a reduction in IL-12 mRNA expression ranging from 20-fold to 30-fold. Other oligomeric compounds, such as ISIS Number 341800, ISIS Number 341811, ISIS Number 341793, ISIS Number 340345 and ISIS Number 341815 resulted in a less pronounced reduction in IL-12 mRNA expression ranging from 1.2-fold to 2-fold.

In a further embodiment, oligomeric compounds ISIS Number 327941 targeting mir-181b and ISIS Number 327921 targeting mir-30d were selected for a dose response study in LPS-stimulated primary macrophages, with and without IFN-gamma pre-treatment. Cells were treated as described herein, with oligomeric compound doses of 75, 150, 300 and 600 nM. Untreated control cells received no oligomeric compound treatment but did receive LPS treatment. ISIS 229927 (SEQ ID NO: 2171) was used as a positive control and ISIS 342683 (SEQ ID NO: 790), ISIS 126690 (SEQ ID NO: 907) and ISIS 289606 (SEQ ID NO: 863) were used as negative controls. IL-12 and IL-6 mRNA expression levels were measured by real-time PCR and normalized to untreated control cells that received LPS treatment. The IL-12 expression data, shown in Table 73, represent the average of 3 treatments. In cells receiving neither oligomeric compound nor LPS treatment, IL-12 expression was undetectable in IFN-gamma stimulated cells and was 1% of the untreated control in unstimulated cells.

TABLE 73

IL-12 mRNA expression following treatment of primary mouse macrophages with oligomeric compounds targeting mir-181b and mir-30d and LPS: dose response study

| ISIS NO: | SEQ ID NO: | IL-12 mRNA expression, % UTC Dose of oligomeric compound | | | | | | | |
|---|---|---|---|---|---|---|---|---|---|
| | | 75 nM | | 150 nM | | 300 nM | | 600 nM | |
| | | −IFN | +IFN | −IFN | +IFN | −IFN | +IFN | −IFN | +IFN |
| 327941 | 359 | 49 | 4 | 45 | 2 | 34 | 3 | 41 | 3 |
| 327921 | 339 | 109 | 14 | 88 | 7 | 67 | 5 | 53 | 5 |
| 229927 | 2171 | 67 | 46 | 53 | 35 | 45 | 16 | 46 | 8 |
| 342683 | 790 | 121 | 92 | 165 | 76 | 147 | 65 | 130 | 64 |
| 129690 | 907 | 114 | 66 | 109 | 54 | 101 | 66 | 128 | 81 |
| 289606 | 863 | 89 | 59 | 99 | 46 | 80 | 52 | 98 | 66 |

These data reveal that ISIS Number 327941 inhibited IL-12 expression in cells stimulated with LPS alone, where the percentage of untreated control ranged from 34% to 49%. ISIS Number 327921 inhibited IL-12 mRNA expression in a dose-dependent manner in cells stimulated with LPS alone, with the lowest IL-12 expression at 53% of untreated control. In cells pretreated with IFN-gamma and subsequently treated with LPS, ISIS Number 327941 markedly reduced IL-12 mRNA expression to less than 5% of the untreated control at all doses. ISIS Number 327921 reduced IL-12 expression to 14% of the control at all 75 nM and to less than 10% of the untreated control at all other doses. Thus, ISIS Number 327941, targeting mir-181b, and ISIS Number 327921, targeting mir-30d, resulted in a greater reduction in IL-12 expression than ISIS 229927, which is targeted to TLR4.

The IL-6 expression data, shown in Table 74, represents the average of 3 treatments. In cells receiving neither oligomeric compound nor LPS treatment, IL-12 expression was undetectable in IFN-gamma stimulated cells and was 2% of the untreated control in unstimulated cells.

TABLE 74

IL-6 mRNA expression following treatment of primary mouse macrophages with oligomeric compounds targeting mir-181b and mir-30d and LPS: dose response study

| ISIS NO: | SEQ ID NO: | IL-6 mRNA expression, % UTC Dose of oligomeric compound | | | | | | | |
|---|---|---|---|---|---|---|---|---|---|
| | | 75 nM | | 150 nM | | 300 nM | | 600 nM | |
| | | −IFN | +IFN | −IFN | +IFN | −IFN | +IFN | −IFN | +IFN |
| 327941 | 359 | 293 | 181 | 325 | 197 | 271 | 197 | 501 | 301 |
| 327921 | 339 | 223 | 122 | 294 | 144 | 522 | 287 | 632 | 313 |
| 229927 | 2171 | 57 | 54 | 52 | 39 | 44 | 40 | 104 | 69 |
| 342683 | 790 | 135 | 115 | 161 | 86 | 156 | 110 | 311 | 149 |
| 129690 | 907 | 98 | 92 | 99 | 86 | 109 | 94 | 258 | 203 |
| 289606 | 863 | 77 | 78 | 68 | 69 | 65 | 70 | 77 | 59 |

These data reveal that, in contrast to IL-12 expression, IL-6 expression is increased in a dose-dependent manner following treatment with ISIS Number 327941 and ISIS Number 327921, in both IFN-gamma-stimulated and unstimulated cells. This is in contrast to treatment with ISIS 229927, which exhibited some reduction in IL-6 expression in both IFN-gamma-stimulated and unstimulated cells.

Abnormalities in the signaling pathways controlling the expression of cytokines and cytokine receptors have been implicated in a number of diseases. Compounds that modulate the activity of macrophages, for example, the response to foreign antigens such as LPS, are candidate therapeutic agents with application in the treatment of conditions involving macrophage activation, such as septic shock and toxic shock The expression of mir-181 in mouse cells and tissues was evaluated by Northern blot. Mouse tissues RNA was purchased from Ambion, Inc. (Austin, Tex.). RNA was prepared from macrophages were prepared and stimulated with LPS as described herein. Northern blotting was performed as described herein, and mir-181 levels were normalized to U6 levels, both of which were quantitated by Phosphorimager analysis. Expression levels are presented in arbitrary units. mir-181 was found to be most highly expressed in lung and kidney, at approximately equal levels. The next highest expression levels were found in brain, heart and liver. For example, as compared to kidney mir-181 expression levels, mir-181 was expressed approximately 2.5-fold lower in brain, approximately 2.2-fold lower in heart and approximately 1.8-fold lower in liver. mir-181 levels in both naive and LPS-stimulated macrophages were 4.5-fold and 4.9-fold lower than in kidney, respectively. The lowest expression levels were found in thymus and spleen, which were 12.9-fold and 14.7-fold less as compared to kidney.

Example 40

Adipocyte Assay of Oligomeric Compounds

The effect of several oligomeric compounds of the present invention targeting miRNA target nucleic acids on the expression of markers of cellular differentiation was examined in differentiating adipocytes.

As described in Example 13, some genes known to be upregulated during adipocyte differentiation include HSL, aP2, Glut4 and PPARγ. These genes play important roles in the uptake of glucose and the metabolism and utilization of fats. An increase in triglyceride content is another well-established marker for adipocyte differentiation.

For assaying adipocyte differentiation, expression of the four hallmark genes, HSL, aP2, Glut4, and PPARγ, as well as triglyceride (TG) accumulation were measured as previously described in adipocytes transfected with oligomeric compounds targeting miRNAs. Triglyceride levels as well as mRNA levels for each of the four adipocyte differentiation hallmark genes are expressed as a percentage of untreated control (UTC) levels. In this experiment, the negative control oligomeric compound was ISIS Number 342672 (SEQ ID NO: 789) or ISIS Number 342673 (SEQ ID NO: 758). Results are shown in Table 75. Each value represents at least one oligomeric compound treatment; data from more than one oligomeric compound treatment were averaged. Where present, "N.D." indicates "not determined".

TABLE 75

Effects of oligomeric compounds targeting miRNAs on expression of adipocyte differentiation markers

| Isis Number | SEQ ID NO | Pri-miRNA | TG | HSL | aP2 | GLUT4 | PPAR gamma |
|---|---|---|---|---|---|---|---|
| UTC | N/A | N/A | 100 | 100 | 100 | 100 | 100 |
| 327873 | 291 | mir-140 | 105 | 116 | 113 | 106 | 104 |
| 327879 | 297 | mir-7-1/ mir-7-1* | 59 | 103 | 103 | 99 | 81 |
| 327881 | 299 | mir-128a | 91 | 93 | 95 | 97 | 98 |

TABLE 75-continued

Effects of oligomeric compounds targeting miRNAs on expression of adipocyte differentiation markers

| Isis Number | SEQ ID NO | Pri-miRNA | TG | HSL | aP2 | GLUT4 | PPAR gamma |
|---|---|---|---|---|---|---|---|
| 327885 | 303 | mir-17/mir-91 | 29 | 57 | 69 | 40 | 59 |
| 327886 | 304 | mir-123/mir-126 | 12 | 22 | 19 | 13 | 25 |
| 327887 | 305 | mir-132 | 54 | 53 | 60 | 43 | 81 |
| 327891 | 309 | mir-212 | 22 | 52 | 56 | 47 | 50 |
| 327895 | 313 | mir-122a | 76 | 88 | 90 | 76 | 86 |
| 327896 | 314 | mir-22 | 22 | 37 | 43 | 35 | 52 |
| 327897 | 315 | mir-92-1 | 28 | 39 | 62 | 32 | 66 |
| 327898 | 316 | mir-142 | 102 | 92 | 96 | 82 | 101 |
| 327899 | 317 | mir-183 | 25 | 27 | 47 | 14 | 62 |
| 327900 | 318 | mir-214 | 26 | 21 | 32 | 12 | 55 |
| 327902 | 320 | mir-192-1 | 55 | 56 | 58 | 15 | 56 |
| 327906 | 324 | mir-103-1 | 25 | 37 | 46 | 14 | 50 |
| 327907 | 325 | mir-26a-1 | 19 | 21 | 29 | 6 | 49 |
| 327910 | 328 | mir-107 | 24 | 32 | 35 | 16 | 39 |
| 327911 | 329 | mir-106 | 59 | 71 | 76 | 48 | 75 |
| 327912 | 330 | let-7f-1 | 112 | 95 | 101 | 79 | 78 |
| 327916 | 334 | mir-124a-2 | 56 | 64 | 67 | 51 | 71 |
| 327917 | 335 | mir-21 | 26 | 26 | 32 | 15 | 54 |
| 327918 | 336 | mir-144 | 65 | 85 | 91 | 66 | 74 |
| 327920 | 338 | mir-222 | 20 | 14 | 22 | 0 | 34 |
| 327921 | 339 | mir-30d | 56 | 76 | 76 | 36 | 75 |
| 327923 | 341 | mir-128b | 88 | 64 | 65 | 54 | 77 |
| 327929 | 347 | mir-199b | 65 | 68 | 62 | 49 | 71 |
| 327935 | 353 | mir-20 | 41 | 61 | 66 | 47 | 67 |
| 327936 | 354 | mir-133a-1 | 23 | 40 | 40 | 6 | 47 |
| 327940 | 358 | mir-199a-2 | 62 | 67 | 62 | 43 | 64 |
| 327943 | 361 | mir-18 | 112 | 109 | 106 | 87 | 98 |
| 327944 | 362 | mir-220 | 38 | 55 | 71 | 28 | 64 |
| 327945 | 363 | mir-24-2 | 48 | 41 | 43 | 26 | 51 |
| 327946 | 364 | mir-211 | 82 | 76 | 73 | 68 | 81 |
| 327949 | 367 | mir-10a | 43 | 49 | 52 | 20 | 54 |
| 327950 | 368 | mir-19a | 125 | 94 | 95 | 104 | 93 |
| 327952 | 370 | mir-137 | 93 | 64 | 56 | 61 | 84 |
| 327957 | 375 | mir-100-1 | 29 | 15 | 23 | 11 | 68 |
| 327958 | 376 | mir-187 | 28 | 5 | 10 | 5 | 55 |
| 327959 | 377 | mir-210 | 33 | 11 | 24 | 152 | 65 |
| 327961 | 379 | mir-223 | 77 | 88 | 91 | 101 | 95 |
| 327962 | 380 | mir-30c-1 | 64 | 77 | 75 | 58 | 80 |
| 327963 | 381 | mir-26b | 124 | 89 | 75 | 91 | 91 |
| 327964 | 382 | mir-152 | 60 | 102 | 96 | 114 | 93 |
| 327965 | 383 | mir-135-1 | 116 | 84 | 67 | 88 | 91 |
| 327966 | 384 | mir-217 | 52 | 56 | 53 | 43 | 77 |
| 327968 | 386 | sterol regulatory element-binding protein-1/mir-33b | 94 | 79 | 67 | 85 | 79 |
| 327969 | 387 | mir-182 | 34 | 45 | 44 | 36 | 67 |
| 327970 | 388 | mir-148a | 48 | 25 | 29 | 27 | 46 |
| 327971 | 389 | mir-23a | 45 | 38 | 49 | 60 | 69 |
| 327972 | 390 | mir-181c | 67 | 70 | 70 | 75 | 85 |
| 328089 | 391 | hypothetical miR-13/miR-190 | 67 | 55 | 50 | 59 | 79 |
| 328090 | 392 | hypothetical miRNA-023 | 128 | 81 | 68 | 86 | 95 |
| 328091 | 393 | hypothetical miRNA-30 | 48 | 40 | 46 | 26 | 85 |
| 328092 | 394 | glutamate receptor, ionotrophic, AMPA 3/hypothetical miRNA-033 | 134 | 80 | 74 | 78 | 86 |
| 328094 | 396 | hypothetical miRNA-040 | 65 | 74 | 68 | 83 | 94 |
| 328095 | 397 | hypothetical miRNA-041 | 110 | 83 | 70 | 98 | 92 |
| 328096 | 398 | hypothetical miRNA-043 | 74 | 76 | 71 | 79 | 89 |
| 328097 | 399 | hypothetical miRNA-044 | 65 | 54 | 48 | 62 | 63 |
| 328098 | 400 | hypothetical miRNA-055 | 39 | 28 | 23 | 25 | 54 |
| 328099 | 401 | hypothetical miRNA-058 | 57 | 74 | 80 | 61 | 72 |
| 328100 | 402 | hypothetical miRNA-070 | 20 | 49 | 47 | 39 | 48 |
| 328101 | 403 | LOG 114614 containing miR-155/hypothetical miRNA-071 | 67 | 78 | 83 | 57 | 70 |
| 328102 | 404 | hypothetical miRNA-075 | 70 | 99 | 96 | 58 | 94 |
| 328103 | 405 | hypothetical miRNA-079 | 113 | 87 | 96 | 86 | 83 |
| 328104 | 406 | hypothetical miRNA-083 | 64 | 81 | 94 | 83 | 73 |
| 328105 | 407 | DiGeorge syndrome critical region gene 8/hypothetical miRNA-088 | 82 | 95 | 102 | 75 | 85 |
| 328106 | 408 | hypothetical miRNA-090 | 70 | 86 | 91 | 79 | 81 |
| 328107 | 409 | hypothetical miRNA-099 | 51 | 55 | 68 | 52 | 71 |
| 328108 | 410 | hypothetical miRNA-101 | 79 | 75 | 87 | 65 | 72 |
| 328109 | 411 | hypothetical miRNA-105 | 23 | 62 | 68 | 55 | 69 |
| 328110 | 412 | hypothetical miRNA-107 | 96 | 84 | 89 | 77 | 80 |
| 328111 | 413 | hypothetical miRNA-111 | 65 | 77 | 79 | 50 | 65 |
| 328113 | 415 | hypothetical miRNA-137 | 74 | 83 | 87 | 78 | 85 |
| 328115 | 417 | hypothetical miRNA-142 | 53 | 75 | 74 | 84 | 80 |
| 328116 | 418 | hypothetical miRNA-143 | 107 | 91 | 99 | 105 | 95 |
| 328117 | 419 | collagen, type I, alpha 1/hypothetical miRNA-144 | 16 | 18 | 28 | 13 | 42 |
| 328118 | 420 | hypothetical miRNA-153 | 69 | 67 | 74 | 57 | 72 |
| 328119 | 421 | hypothetical miRNA-154 | 109 | 101 | 119 | 104 | 102 |
| 328120 | 422 | hypothetical miRNA-156 | 80 | 67 | 80 | 68 | 73 |
| 328121 | 423 | hypothetical miRNA-161 | 119 | 110 | 119 | 115 | 105 |
| 328122 | 424 | hypothetical miRNA-164 | 97 | 89 | 99 | 91 | 103 |
| 328123 | 425 | hypothetical miRNA-166 | 54 | 91 | 119 | 129 | 88 |
| 328124 | 426 | hypothetical miRNA-168-1/similar to ribosomal protein L5 | 108 | 96 | 118 | 105 | 92 |
| 328125 | 427 | forkhead box P2/hypothetical miRNA-169 | 44 | 48 | 75 | 65 | 68 |
| 328126 | 428 | hypothetical miRNA-170 | 108 | 135 | 120 | 107 | 98 |

TABLE 75-continued

Effects of oligomeric compounds targeting miRNAs on expression of adipocyte differentiation markers

| Isis Number | SEQ ID NO | Pri-miRNA | TG | HSL | aP2 | GLUT4 | PPAR gamma |
|---|---|---|---|---|---|---|---|
| 328127 | 429 | glutamate receptor, ionotropic, AMPA 2/hypothetical miRNA-171 | 81 | 93 | 95 | 75 | 85 |
| 328128 | 430 | hypothetical miRNA-172 | 61 | 72 | 90 | 73 | 86 |
| 328129 | 431 | hypothetical miRNA-173 | 19 | 34 | 54 | 36 | 59 |
| 328130 | 432 | hypothetical miRNA-175 | 91 | 64 | 72 | 55 | 77 |
| 328131 | 433 | hypothetical miRNA-176 | 74 | 51 | 63 | 56 | 55 |
| 328133 | 435 | hypothetical miRNA-178 | 43 | 49 | 66 | 59 | 53 |
| 328134 | 436 | hypothetical miRNA-179 | 107 | 109 | 97 | 109 | 86 |
| 328135 | 437 | cezanne 2/hypothetical miRNA-180 | 29 | 20 | 34 | 19 | 33 |
| 328136 | 438 | hypothetical miRNA-181 | 26 | 37 | 57 | 35 | 54 |
| 328137 | 439 | tight junction protein 1 (zona occludens 1)/hypothetical miRNA-183 | 37 | 25 | 45 | 29 | 36 |
| 328138 | 440 | hypothetical miRNA-185 | 80 | 56 | 52 | 52 | 63 |
| 328139 | 441 | hypothetical miRNA-188 | 90 | 116 | 100 | 85 | 91 |
| 340341 | 236 | mir-104 (Mourelatos) | 46 | 49 | 62 | 48 | 71 |
| 340343 | 1780 | mir-105 (Mourelatos) | 35 | 46 | 60 | 33 | 59 |
| 340348 | 848 | mir-93 (Mourelatos) | 48 | 57 | 68 | 52 | 78 |
| 340350 | 855 | mir-95 (Mourelatos) | 38 | 45 | 64 | 53 | 59 |
| 340352 | 1821 | mir-99 (Mourelatos) | 110 | 123 | 107 | 97 | 102 |
| 340354 | 1903 | mir-25 | 64 | 56 | 72 | 61 | 74 |
| 340356 | 1853 | mir-28 | 43 | 59 | 73 | 54 | 62 |
| 340358 | 1825 | mir-31 | 23 | 24 | 47 | 21 | 42 |
| 340360 | 1865 | mir-32 | 106 | 102 | 102 | 91 | 96 |
| 341791 | 1880 | mir-30a | 50 | 72 | 80 | 47 | 75 |
| 341795 | 1762 | mir-199a-2 | 57 | 74 | 76 | 55 | 74 |
| 341796 | 1904 | mir-131-1/mir-9 | 59 | 67 | 74 | 58 | 66 |
| 341797 | 1773 | mir-17/mir-91 | 20 | 29 | 45 | 17 | 50 |
| 341798 | 1871 | mir-123/mir-126 | 62 | 77 | 84 | 55 | 70 |
| 341799 | 1787 | hypothetical miR-13/miR-190 | 98 | 103 | 101 | 89 | 89 |
| 341800 | 1766 | mir-186 | 18 | 42 | 50 | 28 | 61 |
| 341801 | 1839 | mir-198 | 65 | 89 | 90 | 77 | 82 |
| 341802 | 1806 | mir-191 | 155 | 121 | 98 | 85 | 127 |
| 341803 | 760 | mir-206 | N.D. | 79 | 85 | 73 | 68 |
| 341804 | 761 | mir-94/mir-106b | N.D. | 75 | 78 | 62 | 71 |
| 341805 | 762 | mir-184 | N.D. | 86 | 90 | 74 | 77 |
| 341806 | 763 | mir-195 | N.D. | 77 | 83 | 58 | 70 |
| 341807 | 764 | mir-193 | N.D. | 102 | 82 | 101 | 83 |
| 344268 | 1774 | mir-10b | 57 | 44 | 46 | 22 | 53 |
| 344269 | 1890 | mir-29c | 42 | 35 | 41 | 28 | 48 |
| 344275 | 1912 | mir-203 | 36 | 39 | 36 | 21 | 46 |
| 344276 | 1828 | mir-204 | 66 | 68 | 72 | 49 | 72 |
| 344277 | 1767 | mir-1d-2 | 75 | 57 | 61 | 45 | 68 |
| 344338 | 1812 | mir-130a | 103 | 89 | 86 | 66 | 91 |
| 344340 | 1921 | mir-140 | 60 | 47 | 82 | 16 | 67 |
| 344341 | 1823 | mir-218-1 | 50 | 33 | 42 | 14 | 49 |
| 344342 | 1814 | mir-129-2 | 88 | 87 | 88 | 71 | 83 |
| 344343 | 1811 | mir-130b | 32 | 22 | 25 | 4 | 30 |
| 344611 | 1785 | mir-240* (Kosik) | 43 | 31 | 34 | 3 | 34 |
| 344612 | 1790 | mir-232* (Kosik) | 69 | 59 | 72 | 40 | 62 |
| 344613 | 1775 | mir-227* (Kosik)/mir-226* (Kosik) | 47 | 46 | 55 | 38 | 57 |
| 344614 | 1834 | mir-227* (Kosik)/mir-226* (Kosik) | 89 | 71 | 78 | 61 | 86 |
| 344615 | 1900 | mir-244* (Kosik) | 149 | 154 | 166 | 145 | 144 |
| 344616 | 1800 | mir-224* (Kosik) | 32 | 23 | 26 | 2 | 36 |
| 344617 | 1862 | mir-248* (Kosik) | 52 | 55 | 59 | 42 | 72 |
| 346685 | 1884 | mir-27 (Mourelatos) | 164 | 172 | 181 | 233 | 138 |
| 346686 | 1857 | mir-101-1 | 73 | 80 | 83 | 73 | 83 |
| 346687 | 1802 | mir-129-1 | 55 | 53 | 56 | 35 | 60 |
| 346688 | 1898 | mir-182 | 33 | 39 | 48 | 12 | 55 |
| 346689 | 1830 | mir-200b | 59 | 63 | 79 | 45 | 64 |
| 346691 | 1870 | mir-147 (Sanger) | 56 | 69 | 69 | 64 | 79 |
| 346692 | 1889 | mir-224 (Sanger) | 35 | 18 | 26 | 11 | 28 |
| 346693 | 1838 | mir-134 (Sanger) | 69 | 66 | 77 | 65 | 81 |
| 346694 | 1763 | mir-146 (Sanger) | 31 | 18 | 41 | 5 | 32 |
| 346695 | 1824 | mir-150 (Sanger) | 69 | 73 | 72 | 58 | 78 |
| 346906 | 1781 | mir-296 (RFAM/mmu) | 83 | 70 | 77 | 70 | 80 |
| 346907 | 1815 | mir-299 (RFAM/mmu) | 47 | 36 | 50 | 37 | 51 |
| 346908 | 1881 | mir-301 (RFAM/mmu) | 75 | 71 | 77 | 65 | 77 |
| 346909 | 1902 | mir-302 (RFAM/mmu) | 66 | 64 | 68 | 64 | 77 |
| 346910 | 1866 | mir-34a (RFAM/mmu) | 80 | 69 | 78 | 63 | 83 |
| 346913 | 1795 | let-7d | 63 | 58 | 66 | 40 | 59 |
| 346914 | 1810 | mir-94/mir-106b | 41 | 27 | 48 | 16 | 41 |
| 346915 | 1784 | mir-200a | 73 | 67 | 83 | 75 | 90 |
| 346917 | 1826 | mir-31 | 39 | 27 | 33 | 20 | 31 |
| 346919 | 1849 | mir-93 (Mourelatos) | 44 | 45 | 64 | 50 | 65 |
| 346920 | 1801 | mir-96 | 63 | 53 | 70 | 61 | 70 |
| 346921 | 1759 | mir-34 | 52 | 49 | 69 | 51 | 62 |
| 348116 | 1922 | mir-320 | 43 | 58 | 79 | 48 | 76 |
| 348117 | 1860 | mir-321-1 | 66 | 55 | 70 | 73 | 65 |
| 348119 | 1908 | mir-142 | 91 | 76 | 81 | 86 | 90 |
| 348124 | 1820 | mir-198 | 53 | 43 | 59 | 41 | 63 |
| 348125 | 1878 | mir-19b-1 | 79 | 64 | 67 | 65 | 64 |
| 348127 | 1869 | mir-27b | 155 | 150 | 185 | 201 | 130 |

Several compounds were found to have effects on adipocyte differentiation. For example, oligomeric compounds ISIS Number 340348 (SEQ ID NO: 848), targeted to mir-93 (Mourelatos); ISIS Number 341798 (SEQ ID NO: 1871), targeted to mir-123/mir-126; ISIS Number 344340 (SEQ ID NO: 1921) targeted to mir-140; ISIS Number 346687 (SEQ ID NO: 1802), targeted to mir-129-1 and ISIS Number 348117 (SEQ ID NO: 1860), targeted to mir-321-1 were shown to significantly reduce the expression levels of 3 of the 5 markers of adipocyte differentiation. The effects of ISIS Number 327897 (SEQ ID NO: 315), targeted to mir-92-1, were even more pronounced, as shown by the significant reduction in expression of 4 of the 5 markers of differentiation. These data indicate that these oligomeric compounds have the ability to block adipocyte differentiation. Therefore, these oligomeric compounds may be useful as pharmaceutical agents with applications in the treatment, attenuation or prevention of obesity, hyperlipidemia, atherosclerosis, atherogenesis, diabetes, hypertension, or other metabolic diseases as well as having potential applications in the maintenance of the pluripotent phenotype of stem or precursor cells.

Other compounds were shown to stimulate adipocyte differentiation. For example, the oligomeric compounds ISIS Number 328121 (SEQ ID NO: 423), targeted to hypothetical miRNA-161; ISIS Number 344615 (SEQ ID NO: 1900), targeted to mir-244* (Kosik); ISIS Number 346685 (SEQ ID NO: 1884), targeted to mir-27 (Mourelatos); and ISIS Number 348127 (SEQ ID NO: 1869), targeted to mir-27b resulted in significant increases in all 5 markers of adipocyte differentiation. Other oligomeric compounds, for example ISIS Number 340352 (SEQ ID NO: 1821), targeted to mir-99 (Mourelatos) and ISIS Number 328126 (SEQ ID NO: 428), targeted to hypothetical miRNA-170, resulted in increases in 4 of the 5 markers of adipocyte differentiation. These oligomeric compounds may be useful as a pharmaceutical agents in the treatment of diseases in which the induction of adipocyte differentiation is desirable, such as anorexia, or for conditions or injuries in which the induction of cellular differentiation is desireable, such as Alzheimers disease or central nervous system injury, in which regeneration of neural tissue (such as from pluripotent stem cells) would be beneficial. Furthermore, this oligomeric compound may be useful in the treatment, attenuation or prevention of diseases in which it is desireable to induce cellular differentiation and/or quiescence, for example in the treatment of hyperproliferative disorders such as cancer.

In a further embodiment, oligomeric compounds of the present invention were tested for their effects on insulin signaling in HepG2 cells. As described in Example 18, insulin is known to regulate the expression of hepatic IGFBP-1, PEPCK-c and follistatin. Thus, the IGFBP-1, PEPCK-c and follistatin genes serve as marker genes for which mRNA expression can be monitored and used as an indicator of an insulin-resistant state. Oligomeric compounds with the ability to reduce expression of IGFBP-1, PEPCK-c and follistatin are highly desirable as agents potentially useful in the treatment of diabetes and hypertension.oligomeric compounds of the invention were tested for their effects on insulin signalling in liver-derived cells. For assaying insulin signalling, expression of IGFBP-1, PEPCK-c and follistatin mRNAs were measured as previously described in HepG2 cells transfected with oligomeric compounds targeting miRNAs and treated with either no insulin ("basal" Experiment 1, for identification of insulin-mimetic compounds) or with 1 nM insulin ("insulin treated" Experiment 2, for identification of insulin sensitizers) for four hours. At the end of the insulin or no-insulin treatment, total RNA was isolated and real-time PCR was performed on all the total RNA samples using primer/probe sets for three insulin responsive genes: PEPCK-c, IGFBP-1 and follistatin. Expression levels for each gene are normalized to total RNA, and values are expressed relative to the transfectant only untreated control (UTC). In these experiments, the negative control oligomeric compound was ISIS Number 342672 (SEQ ID NO: 789) or ISIS Number 342673 (SEQ ID NO: 758). Results are shown in Tables 76 and 77. Each value represents at least one oligomeric compound treatment; data from more than one oligomeric compound treatment were averaged.

TABLE 76

Experiment 1: Effects of oligomeric compounds targeting miRNAs on insulin-repressed gene expression in HepG2 cells

| Isis Number | SEQ ID NO | Pri-miRNA | Follistatin | IGFBP1 | PEPCKc |
|---|---|---|---|---|---|
| UTC | N/A | N/A | 100 | 100 | 100 |
| 327873 | 291 | mir-140 | 97 | 108 | 72 |
| 327885 | 303 | mir-17/mir-91 | 74 | 161 | 73 |
| 327886 | 304 | mir-123/mir-126 | 82 | 176 | 61 |
| 327887 | 305 | mir-132 | 113 | 119 | 83 |
| 327893 | 311 | let-7b | 93 | 107 | 81 |
| 327895 | 313 | mir-122a | 83 | 108 | 71 |
| 327897 | 315 | mir-92-1 | 129 | 163 | 72 |
| 327899 | 317 | mir-183 | 66 | 105 | 42 |
| 327900 | 318 | mir-214 | 111 | 102 | 88 |
| 327911 | 329 | mir-106 | 81 | 157 | 52 |
| 327916 | 334 | mir-124a-2 | 108 | 102 | 88 |
| 327918 | 336 | mir-144 | 75 | 95 | 81 |
| 327920 | 338 | mir-222 | 99 | 165 | 52 |
| 327923 | 341 | mir-128b | 86 | 116 | 83 |
| 327946 | 364 | mir-211 | 103 | 108 | 90 |
| 327949 | 367 | mir-10a | 112 | 112 | 81 |
| 327950 | 368 | mir-19a | 83 | 109 | 65 |
| 327952 | 370 | mir-137 | 93 | 123 | 70 |
| 327957 | 375 | mir-100-1 | 69 | 143 | 59 |
| 327958 | 376 | mir-187 | 91 | 119 | 73 |
| 327959 | 377 | mir-210 | 98 | 124 | 139 |
| 327961 | 379 | mir-223 | 113 | 150 | 98 |
| 327963 | 381 | mir-26b | 101 | 108 | 92 |
| 327964 | 382 | mir-152 | 97 | 100 | 74 |
| 327965 | 383 | mir-135-1 | 95 | 106 | 63 |
| 341800 | 1766 | mir-186 | 105 | 114 | 71 |
| 341801 | 1839 | mir-198 | 85 | 99 | 73 |
| 341802 | 1806 | mir-191 | 136 | 186 | 98 |
| 341803 | 760 | mir-206 | 68 | 107 | 110 |
| 341804 | 761 | mir-94/mir-106b | 63 | 162 | 44 |
| 341805 | 762 | mir-184 | 63 | 105 | 40 |
| 341806 | 763 | mir-195 | 75 | 128 | 79 |
| 341807 | 764 | mir-193 | 102 | 129 | 97 |
| 341808 | 1861 | mir-185 | 96 | 113 | 64 |

Under "basal" conditions (without insulin), treatments of HepG2 cells with oligomeric compounds of the present invention resulting in decreased mRNA expression levels of the PEPCK-c, IGFBP-1 and/or follistatin marker genes indicate that the oligomeric compounds have an insulin mimetic effect. Treatments with oligomeric compounds of the present invention resulting in an increase in mRNA expression levels of the PEPCK-c, IGFBP-1 and/or follistatin marker genes indicate that these compounds inhibit or counteract the normal insulin repression of mRNA expression of these genes.

From these data, it is evident that the oligomeric compounds, ISIS Number 327886 (SEQ ID NO: 304), targeting mir-123/mir-126; ISIS Number 327899 (SEQ ID NO: 317), targeting mir-183; ISIS Number 327911 (SEQ ID NO: 329), targeting mir-106; ISIS Number 327920 (SEQ ID NO: 338), targeting mir-222; ISIS Number 341804 (SEQ ID NO: 761), targeting mir-94/mir-106b; and ISIS Number 341805 (SEQ ID NO: 762), targeting mir-184, for example, resulted in 39%, 58%, 48%, 48%, 56% and 60% reductions, respectively, in PEPCK-c mRNA, a marker widely considered to be insulin-responsive. Thus, these oligomeric compounds may be useful as pharmaceutic agents comprising insulin mimetic properties in the treatment, amelioration, or prevention of diabetes or other metabolic diseases.

Conversely, the results observed with the oligomeric compounds targeting mir-92-1 (ISIS Number 327897, SEQ ID NO: 315), mir-10a (ISIS Number 327949, SEQ ID NO: 367), mir-223 (ISIS Number 327961, SEQ ID NO: 379) and mir-191 (ISIS Number 341802, SEQ ID NO: 1806), for example, exhibited increased expression of the IGFBP-1 and follistatin marker genes, suggesting that the mir-92-1, mir-10a, mir-223, and mir-191 miRNA targets may be involved in the regulation of these insulin-responsive genes. When these miRNAs are inactivated by an oligomeric compound, IGFBP-1 and follistatin gene expression is no longer repressed. Similarly, treatment oligomeric compounds targeting mir-210 (ISIS Number 327959, SEQ ID NO: 377)) and mir-206 (ISIS Number 341803, SEQ ID NO: 760) resulted in increases in the IGFBP-1 and PEPCK-c marker genes, suggesting that mir-210 and mir-206 may be involved in the regulation of these insulin-responsive genes.

TABLE 77

Experiment 2: Effects of oligomeric compounds targeting miRNAs on insulin-sensitization of gene expression in HepG2 cells

| Isis Number | SEQ ID NO | Pri-miRNA | Follistatin | IGFBP1 | PEPCKc |
|---|---|---|---|---|---|
| UTC + 1 nM insulin | N/A | N/A | 100 | 100 | 100 |
| 327897 | 315 | mir-92-1 | 123 | 243 | 78 |
| 327911 | 329 | mir-106 | 71 | 160 | 78 |
| 327916 | 334 | mir-124a-2 | 98 | 128 | 88 |
| 327918 | 336 | mir-144 | 76 | 81 | 107 |
| 327920 | 338 | mir-222 | 102 | 267 | 59 |
| 327923 | 341 | mir-128b | 106 | 119 | 125 |
| 327946 | 364 | mir-211 | 109 | 138 | 99 |
| 327949 | 367 | mir-10a | 111 | 172 | 101 |
| 327950 | 368 | mir-19a | 89 | 124 | 82 |
| 327952 | 370 | mir-137 | 100 | 103 | 85 |
| 327957 | 375 | mir-100-1 | 73 | 184 | 88 |
| 327958 | 376 | mir-187 | 112 | 149 | 106 |
| 327959 | 377 | mir-210 | 92 | 141 | 156 |
| 327961 | 379 | mir-223 | 128 | 160 | 126 |
| 327963 | 381 | mir-26b | 95 | 111 | 94 |
| 327964 | 382 | mir-152 | 114 | 121 | 122 |
| 327965 | 383 | mir-135-1 | 79 | 105 | 64 |
| 328114 | 416 | hypothetical miRNA-138 | 81 | 177 | 41 |
| 328115 | 417 | hypothetical miRNA-142 | 91 | 120 | 59 |
| 328125 | 427 | forkhead box P2/hypothetical miRNA-169 | 107 | 216 | 77 |
| 328342 | 451 | mir-203 | 88 | 98 | 39 |
| 328343 | 452 | mir-7-1/mir-7-1* | 139 | 135 | 69 |
| 328358 | 467 | mir-123/mir-126 | 106 | 165 | 93 |
| 328367 | 476 | mir-212 | 107 | 141 | 85 |
| 328377 | 486 | hypothetical miRNA-30 | 159 | 247 | 182 |
| 328396 | 505 | mir-205 | 135 | 128 | 65 |
| 328397 | 506 | mir-103-1 | 75 | 57 | 76 |
| 328423 | 532 | mir-19b-2 | 114 | 69 | 77 |
| 328649 | 558 | mir-20 | 69 | 115 | 86 |
| 328702 | 611 | mir-10a | 88 | 83 | 96 |
| 328761 | 670 | hypothetical miRNA-138 | 53 | 193 | 64 |
| 328764 | 673 | hypothetical miRNA-142 | 128 | 145 | 68 |
| 328769 | 678 | mir-26b | 84 | 110 | 100 |
| 328774 | 683 | sterol regulatory | 68 | 100 | 77 |

TABLE 77-continued

Experiment 2: Effects of oligomeric compounds targeting miRNAs on insulin-sensitization of gene expression in HepG2 cells

| Isis Number | SEQ ID NO | Pri-miRNA | Follistatin | IGFBP1 | PEPCKc |
|---|---|---|---|---|---|
| 328776 | 685 | element-binding protein-1/mir-33b forkhead box P2/hypothetical miRNA-169 | 114 | 86 | 125 |

For HepG2 cells treated with 1 nM insulin, treatments with oligomeric compounds of the present invention resulting in a decrease in mRNA expression levels of the PEPCK-c, IGFBP-1 and/or follistatin marker genes indicate that these compounds have an insulin sensitization effect. Treatments with oligomeric compounds of the present invention resulting in an increase in mRNA expression levels of the PEPCK-c, IGFBP-1 and/or follistatin marker genes indicate that these compounds inhibit or counteract the normal insulin response of repression of mRNA expression of these genes.

From these data, it is evident that the oligomeric compounds, ISIS Number 327920 (SEQ ID NO: 338), targeting mir-222; ISIS Number 328114 (SEQ ID NO: 416), targeting hypothetical miRNA-138; ISIS Number 328115 (SEQ ID NO: 417), targeting hypothetical miRNA-142; and ISIS Number 328342 (SEQ ID NO: 451) targeting mir-203, for example, were observed to result in a 41%, a 59%, a 41% and a 61% reduction, respectively, of PEPCK-c mRNA expression, widely considered to be a marker of insulin-responsiveness. Thus, these oligomeric compounds may be useful as pharmaceutic agents with insulin-sensitizing properties in the treatment, amelioration, or prevention of diabetes or other metabolic diseases.

Conversely, the results observed with the oligomeric compounds targeting mir-128b (ISIS Number 327923, SEQ ID NO: 341), mir-223 (ISIS Number 327961, SEQ ID NO: 379), mir-152 (ISIS Number 327964, SEQ ID NO: 382) and hypothetical miRNA-30 (ISIS Number 328377, SEQ ID NO: 486), all exhibiting increased expression of the IGFBP-1, PEPCK-c and follistatin marker genes, support the conclusion that the mir-128b, mir-223, mir-152 and hypothetical miRNA-30 may be involved in the regulation of insulin-responsive genes. When these miRNAs are inactivated by the oligomeric compounds of the present invention, IGFBP-1, PEPCK-c and follistatin gene expression is no longer repressed or insulin-sensitive.

Various modifications of the invention, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety.

SEQUENCE LISTING (2184 sequences)

SEQ ID NO: 1 - DNA, 20 bp, Artificial Sequence
  Oligomeric compound
tccgtcatcgctcctcaggg

SEQ ID NO: 2 - DNA, 20 bp, Artificial Sequence
  Oligomeric compound
gtgcgcgcgagcccgaaatc

SEQ ID NO: 3 - DNA, 20 bp, Artificial Sequence
  Oligomeric compound
atgcattctgcccccaagga

SEQ ID NO: 4 - RNA, 110 nt, H. sapiens
cugugugugucucucucuguguccugccagugguuuuacccuaugguagguuacgucaugcuguucuaccacaggguagaaccacggacaggauaccggggcacccucug

SEQ ID NO: 5 - RNA, 110 nt, H. sapiens
uauauugcuguugacagugagcgacuguaaacauccucgacuggaagcugugaagccacagaugggcuuucagucggauguuugcagcugccuacugccucggacuucaa

SEQ ID NO: 6 - RNA, 110 nt, H. sapiens
ggccagcugugaguguuucuuuggcagugucuuagcugguuguugugagcaauaguaaggaagcaaucagcaaguauacugcccuagaagugcugcacguuguggggccc

SEQ ID NO: 7 - RNA, 110 nt, H. sapiens
ucauugagauccucuucuucuggaagcugguuucacaugguggcuuagauuuuuccaucuuuguaucuagcaccauuugaaaucaguguuuuaggaguaagaauugcagc

SEQ ID NO: 8 - RNA, 110 nt, H. sapiens
gaucauaaagcuucuucaggaagcugguuucauauggugguuuagauuuaaauagugauugucuagcaccauuugaaaucaguguucuugggggagaccagcugcgcugc

SEQ ID NO: 9 - RNA, 110 nt, H. sapiens
augaacugacauacuuguuccacucuagcagcacguaaauauuggcguagugaaauauauauuaaacaccaauauuacugugcugcuuuagugugacagggauacagcaa

SEQ ID NO: 10 - RNA, 110 nt, H. sapiens
guguuggggacucgcgcgcuggguccagugguucuuaacaguucaacaguucuguagcgcaauugugaaauguuuaggaccacuagacccggcgggcgcggcgacagcga

SEQ ID NO: 11 - RNA, 110 nt, H. sapiens
uuggauguuggccuaguucuguguggaagacuagugauuuuguuguuuuuagauaacuaaaucgacaacaaaucacagucugccauauggcacaggccaugccucuacag

SEQ ID NO: 12 - RNA, 110 nt, H. sapiens
ccagagguuguaacguugucuauauauacccuguagaaccgaauuugugugguauccguauagucacagauucgauucuaggggaauauauggucgaugcaaaaacuuca

SEQ ID NO: 13 - RNA, 110 nt, H. sapiens
ugcaauaauuggccuuguuccugagcuguuggauucggggccguagcacugucugagagguuuacauuucucacagugaaccggucucuuuuucagcugcuuccuggcuu

SEQ ID NO: 14 - RNA, 110 nt, H. sapiens
ucucucucucccucacagcugccagugucauuuuugugaucugcagcuaguauucucacuccaguugcauagucacaaaagugaucauuggcagguguggcugcugcaug

SEQ ID NO: 15 - RNA, 110 nt, H. sapiens
ugccagcuaauuagcgguggccagugucauuuuugugauguugcagcuaguaauaugagcccaguugcauagucacaaaagugaucauuggaaacugugacuguacugca

SEQ ID NO: 16 - RNA, 110 nt, H. sapiens
cuggaugccuuuucugcaggccucugugugauauguuugauauauuagguuguuauuuaauccaacuauauaucaaacauauuccuacagugucuugcccugucuccggg

SEQ ID NO: 17 - RNA, 110 nt, H. sapiens
ugaccucucuaacaaggugcagagcuuagcugauuggugaacagugauugguuuccgcuuuguucacaguggcuaaguucugcaccugaagagaaggugagauggggaca

SEQ ID NO: 18 - RNA, 110 nt, H. sapiens
cagugccaucugcuuggccgauuuuggcacuagcacauuuuugcuugugucucuccgcucugagcaaucaugugcagugccaauaugggaaaagcaggacccgcagcugc

SEQ ID NO: 19 - RNA, 110 nt, H. sapiens
agucagaauaaugucaaagugcuuacagugcagguagugauaugugcaucuacugcagugaaggcacuuguagcauuauggugacagcugccucgggaagccaaguuggg

SEQ ID NO: 20 - RNA, 110 nt, H. sapiens
gccacgccuccgcuggcgacgggacauuauuacuuuugguacgcgcugugacacuucaaacucguaccgugaguaauaaugcgccguccacggcaccgcaucgaaaacgc

SEQ ID NO: 21 - RNA, 110 nt, H. sapiens
cgcgccccgcccccgcgucuccagggcaaccguggcuuucgauuguuacugugggaacuggagguaacagucuacagccauggucgccccgcagcacgcccacgcgccgc

SEQ ID NO: 22 - RNA, 110 nt, H. sapiens
gcugcccgaugcacacugcaagaacaauaaggauuuuuaggggcauuaugacugagucagaaaacacagcugccccugaaagucccucauuuuucuugcuguccuugaac

SEQ ID NO: 23 - RNA, 110 nt, H. sapiens
gcgcugcucucaggugcucuggcugcuuggguuccuggcaugcugauuugugacuuaagauuaaaaucacauugccagggauuaccacgcaaccacgaccuuggcugcuc

SEQ ID NO: 24 - RNA, 110 nt, H. sapiens
acaccauggcccuggcugagguaguaguuugugcuguuggucggguugugacauugcccgcuguggagauaacugcgcaagcuacugccuugcuagugcuggugaugcuc

SEQ ID NO: 25 - RNA, 110 nt, H. sapiens
cggggcaccccgcccggacagcgcgccggcaccuuggcucuagacugcuuacugcccgggccgcccucaguaacagucuccagucacggccaccgacgccuggccccgcc

SEQ ID NO: 26 - RNA, 110 nt, H. sapiens
agauuuaauuagcucagagaagaaauguugcuugggcaagaggacuuuuuaauuaucagcuuggauaaauuugaaaauguugaugccuagggguugaguuaauuaaaacc

SEQ ID NO: 27 - RNA, 110 nt, H. sapiens
gccugugugggaagcgaguuguuaucuuugguuaucuagcuguaugaguguauuggucuucauaaagcuagauaaccgaaaguaaaaacuccuucaagaucgccggggag

SEQ ID NO: 28 - RNA, 110 nt, H. sapiens
ggccgggccuggcggggugagguaguagguugugugguuucagggcagugauguugccccucggaagauaacuauacaaccuacugccuucccugaggagcccagugaca

SEQ ID NO: 29 - RNA, 110 nt, H. sapiens
cugcaugcagacugccugcuugggaaacauacuucuuuauaugcccauauggaccugcuaagcuauggaauguaaagaaguauguaucucaggccgggaccucucucgcc

SEQ ID NO: 30 - RNA, 110 nt, H. sapiens
uggcuacagaguuuccuuagcagagcuguggagugugacaaugguguuugugucuaaacuaucaaacgccauuaucacacuaaauagcuacugcuaggcaauccuucccu

SEQ ID NO: 31 - RNA, 110 nt, H. sapiens
gcccucaccuggcugagccgcaguaguucuucaguggcaagcuuuauguccugacccagcuaaagcugccaguugaagaacuguugcccucugccccuggcuucgaggag

SEQ ID NO: 32 - RNA, 110 nt, H. sapiens
aagggaaacucaaaccccuuucuacacagguugggaucgguugcaaugcuguguuucuguaugguauugcacuugucccggccuguugaguuugguggggauugugacca

SEQ ID NO: 33 - RNA, 110 nt, H. sapiens
cuacugcuguugguggcagcuugguggucguaugugugacgccauuuacuugaaccuuuaggagugacaucacauauacggcagcuaaacugcuacaugggacaacaauu

SEQ ID NO: 34 - RNA, 110 nt, H. sapiens
cgacggacagacagacagugcagucacccauaaaguagaaagcacuacuaacagcacuggaggguguaguguuuccuacuuuauggaugaguguacugugggcuucggag

SEQ ID NO: 35 - RNA, 110 nt, H. sapiens
ccgcagagugugacuccuguucuguguauggcacugguagaauucacugugaacagucucagucagugaauuaccgaagggccauaaacagagcagagacagauccacga

SEQ ID NO: 36 - RNA, 110 nt, H. sapiens
ugguguggcaaccccuaaaggcucagcauuaagguggguggaauaauauaacaauauccguguuguuauaguauuccaccuacccugaugcauuuuguugucauuuucuu

SEQ ID NO: 37 - RNA, 110 nt, H. sapiens
ggccuggcuggacagaguugucaugugucugccugucuacacuugcugugcagaacauccgcucaccuguacagcaggcacagacaggcagucacaugacaacccagccu

SEQ ID NO: 38 - RNA, 110 nt, H. sapiens
agcagcgcagcgcccugucucccagccugaggugcagugcugcaucucuggucaguugggagucugagaugaagcacuguagcucaggaagagagaaguuguucugcagc

SEQ ID NO: 39 - RNA, 110 nt, H. sapiens
gccgagaccgagugcacagggcucugaccuaugaauugacagccagugcucucgucuccccucuggcugccaauuccauaggucacagguauguucgccucaaugccagc

SEQ ID NO: 40-41 - skipped (2 entries)

SEQ ID NO: 42 - RNA, 110 nt, H. sapiens
ccccugugccuugggcgggcggcuguuaagacuugcagugauguuuaacuccucuccacgugaacaucacagcaagucugugcugcuucccgucccuacgcugccugggc

SEQ ID NO: 43 - RNA, 110 nt, H. sapiens
gccagcaaauaauggcuguuguauuagcugcuuuugaugauaguaugaaagaaguauuagcacuugucaacaaaacugcuuacaacauaacauuagcaugcaugggcugc

SEQ ID NO: 44 - RNA, 110 nt, H. sapiens
cauacacggcuguuacacagguuuucccaugauaaggcaauagguuaaugaaaugcucauuucauuuuaccaguuguuuucucugugaaguuccgauaaguagcaaacca

SEQ ID NO: 45 - RNA, 110 nt, H. sapiens
cgacugcccuuuggggugagguaguagguuguauaguuuggggcucugcccugcuaugggauaacuauacaaucuacugucuuuccugaaguggcuguaauaucugcggu

SEQ ID NO: 46 - RNA, 110 nt, H. sapiens
ccccuuauaggcccauuuugacaggaaaucuuugagaggcagcagcaaugaagugcccagagauuucaucugucuucuuuugcuuuaggaaaugcugagcgcaaggcucc

SEQ ID NO: 47 - RNA, 110 nt, H. sapiens
gccugaaaugaaauuaccauauuuuuaaucuuaauuuuccacucuguuuaucugacaguguggaugugcaauccaaacagauaaugagagagugggauauugacaccgcu

SEQ ID NO: 48 - RNA, 110 nt, H. sapiens
agaagggcuaucaggccagccuucagaggacuccaaggaacauucaacgcugucggugaguuugggauuugaaaaaaccacugaccguugacuguaccuugggguccuua

SEQ ID NO: 49 - RNA, 110 nt, H. sapiens
guucucuucacugugggaugagguaguagguuguauaguuuuagggucacacccaccacugggagauaacuauacaaucuacugucuuuccuaacgugauagaaaagucu

SEQ ID NO: 50 - RNA, 110 nt, H. sapiens
aaagauccucagacaauccaugugcuucucuuguccuucauuccaccggagucugucucauacccaaccagauuucaguggagugaaguucaggaggcauggagcugaca

SEQ ID NO: 51 - RNA, 110 nt, H. sapiens
gaaguuuucuuacugcccucggcuucuuuacagugcugccuuguugcauauggaucaagcagcauuguacagggcuaugaaggcauugagaccuguucuucaugauauuu

SEQ ID NO: 52 - RNA, 110 nt, H. sapiens
ggcccuggcgaaggccguggccucguucaaguaauccaggauaggcugugcaggucccaauggccuaucuugguuacuugcacggggacgcgggccuggacgccggcauc

SEQ ID NO: 53 - RNA, 110 nt, H. sapiens
ggccgcauaccuccuggcgggcagcuguggugcauuguaguugcauugcauguucuggugguacccaugcaauguuuccacagugcaucacagaggccugccuggcccuc

SEQ ID NO: 54 - RNA, 110 nt, H. sapiens
ugcucgcucagcugaucuguggcuuagguaguuucauguuguugggauugaguuuugaacucggcaacaagaaacugccugaguuacaucagucgguuuucgucgagggc

SEQ ID NO: 55 - RNA, 110 nt, H. sapiens
ugcaauauucgauauucucucugcuuucagcuucuuuacaguguugccuuguggcauggaguucaagcagcauuguacagggcuaucaaagcacagagagcuugcuacag

SEQ ID NO: 56 - RNA, 110 nt, H. sapiens
aaauuuugcuacaggaauaggccuuggccauguaaaagugcuuacagugcagguagcuuuuugagaucuacugcaauguaagcacuucuuacauuaccauggugauuuag

SEQ ID NO: 57 - RNA, 110 nt, H. sapiens
auugcucuaucagagugagguaguagauuguauaguugugggguagugauuuuacccuguucaggagauaacuauacaaucuauugccuucccugaggaguagacuugcu

SEQ ID NO: 58 - RNA, 110 nt, H. sapiens
uugagcaugaugaaugauuggagucagagaagcggcgugauaaauggcagcaccuuggcuccauugcaugcccuauugauucuccuucuuuauuacuccuacaacccagc

SEQ ID NO: 59 - RNA, 110 nt, H. sapiens
accacuggcccaucucuuacacaggcugaccgauuucuccugguguucagagucuguuuuugucuagcaccauuugaaaucgguuaugauguagggggaaaagcagcagc

SEQ ID NO: 60 - RNA, 110 nt, H. sapiens
ccggcaugccucugcugcuggccagagcucuuuucacauugugcuacugucugcaccugucacuagcagugcaauguuaaaagggcauuggccguguagugcuacccagc

SEQ ID NO: 61 - RNA, 110 nt, H. sapiens
uaucaucuugucagaugcuuaauguucuuccuccugucacuuuggauaggcccaauuuguagaauacugcagagguaaaagaagacaauuaacagugacaggaugguaau

SEQ ID NO: 62 - RNA, 110 nt, H. sapiens
gugauaauguagcgagauuuucuguugugcuugaucuaaccaugugguugcgagguaugaguaaaacaugguuccgucaagcaccauggaacgucacgcagcuuucuaca

SEQ ID NO: 63 - RNA, 110 nt, H. sapiens
aucaagauuagaggcucugcucuccguguucacagcggaccuugauuuaaugucauacaauuaaggcacgcggugaaugccaagagcggagccuacggcugcacuugaag

SEQ ID NO: 64 - RNA, 110 nt, H. sapiens
cuccauggcuguaccaccuugucggguagcuuaucagacugauguugacuguugaaucucauggcaacaccagucgaugggcugucugacauuuugguaucuuucaucug

SEQ ID NO: 65 - RNA, 110 nt, H. sapiens
agcucuuaugauagcaaugucagcagugccuuagcagcacguaaauauuggcguuaagauucuaaaauuaucuccaguauuaacugugcugcugaaguaagguugaccau

SEQ ID NO: 66 - RNA, 110 nt, H. sapiens
uccugugcccccaguggggcccuggcugggauaucaucauauacuguaaguuugcgaugagacacuacaguauagaugauguacuaguccgggcacccccagcucuggag

SEQ ID NO: 67 - RNA, 110 nt, H. sapiens
ugaacauccaggucuggggcaugaaccuggcauacaauguagauuucuguguucguuaggcaacagcuacauugucugcuggguuucaggcuaccuggaaacauguucuc

SEQ ID NO: 68 - RNA, 110 nt, H. sapiens
gcugcuggaagguguagguacccucaauggcucaguagccaguguagauccugucuuucguaaucagcagcuacaucuggcuacugggucucugauggcaucuucuagcu

SEQ ID NO: 69 - RNA, 110 nt, H. sapiens
ucuuguucagaaagucuguuguuguaaacauccccgacuggaagcuguaagacacagcuaagcuuucagucagauguuugcugcuaccggcuauucacagacauccucuu

SEQ ID NO: 70 - RNA, 110 nt, H. sapiens
caaagacauugcuacuuacaauuaguuuugcagguuugcauuucagcguauauauguauauguggcugugcaaauccaugcaaaacugauugugauaaugugugcuuccu

SEQ ID NO: 71 - RNA, 110 nt, H. sapiens
gcccggcagccacugugcagugggaaggggggccgauacacuguacgagagugaguagcaggucucacagugaaccggucucuuucccuacugugucacacuccuaaugg

SEQ ID NO: 72 - RNA, 110 nt, H. sapiens
gggcccugaacucaggggcuucgccacugauuguccaaacgcaauucuuguacgagucugcggccaaccgagaauuguggcuggacaucuguggcugagcuccgggcgca

SEQ ID NO: 73 - RNA, 110 nt, H. sapiens
uucgaugcuugaagaugucagacuguagaaucucuacggguaagugugugauuuccucagugacaucacauuugccugcagagauuuuccagucugccacuuugaaguug

SEQ ID NO: 74 - RNA, 110 nt, H. sapiens
gcuugcuguaggcuguaugcuguuaaugcuaaucgugauagggguuuuugccuccaacugacuccuacauauuagcauuaacaguguaugaugccuguuacuagcauuca

SEQ ID NO: 75 - RNA, 110 nt, H. sapiens
aagcuucuucaggaagcugguuucauauggugguuuagauuuaaauagugauugucuagcaccauuugaaaucaguguucuugggggagaccagcugcgcugcacuacca

SEQ ID NO: 76 - RNA, 110 nt, H. sapiens
ggcauauucugcccuucgcgaaucuuuuugcggucugggcuugcuguacauaacucaauagccggaagcccuuaccccaaaaagcauuugcggagggcgcacucgucgag

SEQ ID NO: 77 - RNA, 110 nt, H. sapiens
cagaagaaagaugcccccugcucuggcuggucaaacggaaccaaguccgucuuccugagagguuugguccccuucaaccagcuacagcagggcuggcaaugcccaguccu

SEQ ID NO: 78 - RNA, 110 nt, H. sapiens
agcgcagcuuuaauuacucaugcugcugguuaaaauauuaauggggcacagaguguugcaugcucauuucuguugauuuuuaauuagcaguaauucauuuugcacaaagc

SEQ ID NO: 79 - RNA, 110 nt, H. sapiens
aaaaaaauggguuccuaggaagagguaguagguugcauaguuuuagggcagggauuuugcccacaaggagguaacuauacgaccugcugccuuucuuagggccuuauuau

SEQ ID NO: 80 - RNA, 110 nt, H. sapiens
aauccuacauuuuugaggccuuaaaguacuguagcagcacaucaugguuuacaugcuacagucaagaugcgaaucauuauuugcugcucuagaaauuuaaggaaauucau

SEQ ID NO: 81 - RNA, 110 nt, H. sapiens
acgaccuucugugaccccuuagaggaugacugauuucuuuugguguucagagucaauauaauuuucuagcaccaucugaaaucgguuauaaugauuggggaagagcacca

SEQ ID NO: 82 - RNA, 110 nt, H. sapiens
caaagcucuccugccugcuucugugugauauguuugauauuggguuguuuaauuaggaaccaacuaaaugucaaacauauucuuacagcagcaggugauucagcaccacc

SEQ ID NO: 83 - RNA, 110 nt, H. sapiens
ccagaggacaccuccacuccgucuacccaguguuuagacuaucuguucaggacucccaaauuguacaguagucugcacauugguuaggcugggcuggguuagacccucgg

SEQ ID NO: 84 - RNA, 110 nt, H. sapiens
ggauggcugcugucuccuuuggaucuuuuugcggucugggcuugcuguuccucucaacaguagucaggaagcccuuaccccaaaaaguaucugcgggaggccuuguccac

SEQ ID NO: 85 - RNA, 110 nt, H. sapiens
accugccgcgccccccgggcugagguaggagguuguauaguugaggaggacacccaaggagaucacuauacggccuccuagcuuuccccaggcugcgcccugcacgggac

SEQ ID NO: 86 - RNA, 110 nt, H. sapiens
uggcagguuguuuaguuuuuucguuugaagguuuucauuagucuaaugaggacugugcaagggcgagcagucagcacaauuuacauggggaagcuaucauaauaaaugaa

SEQ ID NO: 87 - RNA, 110 nt, H. sapiens
agcugugugcauccggguugagguaguagguuguaugguuuagaguuacacccugggaguuaacuguacaaccuucuagcuuuccuuggagcacacuugagccgucgagg

SEQ ID NO: 88 - RNA, 110 nt, H. sapiens
ggcuacagucuuucuucaugugacucguggacuucccuuugucauccuaugccugagaauauaugaaggaggcugggaaggcaaagggacguucaauugucaucacuggc

SEQ ID NO: 89 - RNA, 110 nt, H. sapiens
ccacucgcucccaccuuguccucacgguccaguuuucccaggaaucccuuagaugcuaagauggggauuccuggaaauacuguucuugaggucaugguuucacagcugga

SEQ ID NO: 90 - RNA, 110 nt, H. sapiens
uccuuccucaggagaaaggccucucucuccguguucacagcggaccuugauuuaaauguccauacaauuaaggcacgcggugaaugccaagaauggggcuggcugagcac

SEQ ID NO: 91 - RNA, 110 nt, H. sapiens
agucgccagucacuuaagcugagugcauugugauuuccaauaauugaggcagugguucuaaaagcugucuacauuaaugaaaagagcaauguggccagcuugacuaagcc

SEQ ID NO: 92 - RNA, 110 nt, H. sapiens
ugaguuuugagguugcuucagugaacauucaacgcugucggugaguuuggaauuaaaaucaaaaccaucgaccguugauuguacccuauggcuaaccaucaucuacucca

SEQ ID NO: 93 - RNA, 110 nt, H. sapiens
cagcgauacauuaaugcucauuuggcucugcaaaucuuaccguuugcuuaggccaaauggcgcaucaaugacuaucgcucuuacaaagcucuugaaucaguauuauguaa

SEQ ID NO: 94 - RNA, 110 nt, H. sapiens
uaucugaugugacagcuucuguagcacuaaagugcuuauagugcagguaguguuuaguuaucuacugcauuaugagcacuuaaaguacugcuagcuguagaacuccagcu

SEQ ID NO: 95 - RNA, 110 nt, H. sapiens
cuagcagcacuacaaugcuuugcuagagcugguaaaauggaaccaaaucgccucuucaauggauuugguccccuucaaccagcuguagcuaugcauugauuacuacggga

SEQ ID NO: 96 - RNA, 110 nt, H. sapiens
gcggaguucugguaucguugcugcagcugguguugugaaucaggccgacgagcagcgcauccucuuacccggcuauuucacgacaccaggguugcaucauacccauccuc

SEQ ID NO: 97 - RNA, 110 nt, H. sapiens
cugcucaugccagggugagguaguaaguuguauuguugugggguagggauauuaggccccaauuagaagauaacuauacaacuuacuacuuucccugguguguggcauau

SEQ ID NO: 98 - RNA, 110 nt, H. sapiens
cuagagcuugaauuggaacugcugagugaauuagguaguuucauguuguugggccuggguuucugaacacaacaacauuaaaccacccgauucacggcaguuacugcucc

SEQ ID NO: 99 - RNA, 110 nt, H. sapiens
aacauuguugcgcuccucucagucccugagacccuaacuugugauguuuaccguuuaaauccacggguuaggcucuugggagcugcgagucgugcuuuugcauccuggaa

SEQ ID NO: 100 - RNA, 110 nt, H. sapiens
aggaagcuucuggagauccugcuccgucgccccaguguucagacuaccuguucaggacaaugccguuguacaguagucugcacauugguuagacugggcaagggagagca

SEQ ID NO: 101 - RNA, 110 nt, H. sapiens
accuucugugaccccuuagaggaugacugauuucuuuugguguucagagucaauauaauuuucuagcaccaucugaaaucgguuauaaugauuggggaagagcaccauga

SEQ ID NO: 102 - RNA, 110 nt, H. sapiens
cuggggaggugagccugaaaacaaaggcagauagagaagucacagcucacuggugagggagcuagagaguuguuuucuuaauacccucugccuuugaaucugccuagauu

SEQ ID NO: 103 - RNA, 110 nt, H. sapiens
ccugugcagagauuauuuuuuaaaaggucacaaucaacauucauugcugucgguggguugaacuguguggacaagcucacugaacaaugaaugcaacuguggccccgcuu

SEQ ID NO: 104 - RNA, 110 nt, H. sapiens
guauauucagggacaggccauugacagucaauuaacaaguuugauugguaugucaacucauucuuuugaauuguuaauaguauguuaauagcauucguuucuuugugcag

SEQ ID NO: 105 - RNA, 110 nt, H. sapiens
cugucggccggcccuggguccaucuuccaguacaguguuggauggucuaauugugaagcuccuaacacugucugguaaagauggcucccggguggguucucucggcagua

SEQ ID NO: 106 - RNA, 110 nt, H. sapiens
gccaggaggcgggguugguuguuaucuuugguuaucuagcuguaugagugguguggagucuucauaaagcuagauaaccgaaaguaaaaauaaccccauacacugcgcag

SEQ ID NO: 107 - RNA, 110 nt, H. sapiens
ucggaucugggagccaaaugcuuugcuagagcugguaaaauggaaccaaaucgacuguccaauggauuugguccccuucaaccagcuguagcugugcauugauggcgccg

SEQ ID NO: 108 - RNA, 110 nt, H. sapiens
ccgccucagagccgcccgccguuccuuuuuccuaugcauauacuucuuugaggaucuggccuaaagagguauagggcaugggaaaacggggcggucggguccuccccagc

SEQ ID NO: 109 - RNA, 110 nt, H. sapiens
cgccucagagccgcccgccguuccuuuuuccuaugcauauacuucuuugaggaucuggccuaaagagguauagggcaugggaaaacggggcggucggguccuccccagcg

SEQ ID NO: 110 - RNA, 110 nt, H. sapiens
cuauaaugcuuagauuaucaaucaucuugacaguuuauuggcuuuaucaccacacauaccauuaaaaugaugucuggccuagacugucaggagcaaacauuaaacagacc

SEQ ID NO: 111 - RNA, 110 nt, H. sapiens
acagcuaacaacuuaguaauaccuacucagaguacauacuucuuuauguacccauaugaacauacaaugcuauggaauguaaagaaguauguauuuuugguaggcaauaa

SEQ ID NO: 112 - RNA, 110 nt, H. sapiens
auguugagugcuuuuuguucuaaggugcaucuagugcagauagugaaguagauuagcaucuacugcccuaagugcuccuucuggcauaagaaguuauguauucauccaau

SEQ ID NO: 113 - RNA, 110 nt, H. sapiens
gacaguguggcauuguagggcuccacaccguaucugacacuuugggcgagggcaccaugcugaagguguucaugaugcggucugggaacuccucacggaucuuacugaug

SEQ ID NO: 114 - RNA, 110 nt, H. sapiens
cucuggccuccgcuuccuccuccuccgacucggacaccggcggagccuccccgcccccgcggaagaaaccccgagccucggcggcggagggaguaggagagcccggggcu

SEQ ID NO: 115 - RNA, 110 nt, H. sapiens
agauuagaguggcuguggucuagugcuguguggaagacuagugauuuuguuguucugauguacuacgacaacaagucacagccggccucauagcgcagacucccuucgac

SEQ ID NO: 116 - RNA, 110 nt, H. sapiens
gaccagucgcugcggggcuuuccuuugugcuugaucuaaccaugugguggaacgauggaaacggaacaugguucugucaagcaccgcggaaagcaccgugcucuccugca

SEQ ID NO: 117 - RNA, 110 nt, H. sapiens
gccuggccucccugggcucugccucccgugccuacugagcugaaacacaguugguuuguguacacuggcucaguucagcaggaacaggggucaagcccccuuggagccug

SEQ ID NO: 118 - RNA, 110 nt, H. sapiens
cugucgauuggacccgcccuccggugccuacugagcugauaucaguucucauuuuacacacuggcucaguucagcaggaacaggagucgagcccuugagcaaaaagccuu

SEQ ID NO: 119 - RNA, 110 nt, H. sapiens
cucagcagagcugcgucuuugugcuuucagcuucuuuacagugcugccuuguagcauucaggucaagcagcauuguacagggcuaugaaagaaccaagaaugggcugccc

SEQ ID NO: 120 - RNA, 110 nt, H. sapiens
ucaccuggccaugugacuugugggcuucccuuugucauccuucgccuagggcucugagcagggcagggacagcaaaggggugcucaguugucacuucccacagcacggag

SEQ ID NO: 121 - RNA, 110 nt, H. sapiens
agguagauaugagacugaacuguccuuuuucgguuaucaugguaccgaugcuguauaucugaaagguacaguacugugauaacugaagaaugguggugccaucacauuga

SEQ ID NO: 122 - RNA, 110 nt, H. sapiens
ccaaguuucaguucauguaaacauccuacacucagcuguaauacauggauuggcugggagguggauguuuacuucagcugacuuggaaugucaaccaauuaacauugaua

SEQ ID NO: 123 - RNA, 110 nt, H. sapiens
ggcuucuuccagucauccugagguagauaucauccaggaaugcugaggccuuauggcuuacagcaauccaguaaugauauaaaaggugauuggagguuagauuuacauug

SEQ ID NO: 124 - RNA, 110 nt, H. sapiens
ugugacugcaugcucccagguugagguaguagguuguauaguuuagaauuacaucaagggagauaacuguacagccuccuagcuuuccuugggucuugcacuaaacaaca

SEQ ID NO: 125 - RNA, 110 nt, H. sapiens
gaucugucugucuucuguauauacccuguagauccgaauuuguguaaggaauuuuguggucacaaauucguaucuaggggaauauguaguugacauaaacacuccgcucu

SEQ ID NO: 126 - RNA, 110 nt, H. sapiens
uugcaguccucuguuaguuuugcauaguugcacuacaagaagaauguaguugugcaaaucuaugcaaaacugaugguggccugcuauuuccuucaaaugaaugauuuuua

SEQ ID NO: 127 - RNA, 110 nt, H. sapiens
acacuggugcucugugggaugagguaguagauuguauaguuuuagggucauaccccaucuuggagauaacuauacagucuacugucuuucccacggugguacacuucuuc

SEQ ID NO: 128 - RNA, 110 nt, H. sapiens
cgcgaauguguguuuaaaaaaaauaaaaccuuggaguaaaguagcagcacauaaugguuuguggauuuugaaaaggugcaggccauauugugcugccucaaaaauacaag

SEQ ID NO: 129 - RNA, 110 nt, H. sapiens
ccgaggaauacugcaagagcaauaaggauuuuuaggggcauuaugauaguggaauggaaacacaucugcccccaaaagucccucauuuucccugcgguaacgaaccagcu

SEQ ID NO: 130 - RNA, 110 nt, H. sapiens
cuugguccucugacucucuucggugacggguauucuuggguggauaauacggauuacguuguuauugcuuaagaauacgcguagucgaggagaguaccagcggcaggggg

SEQ ID NO: 131 - RNA, 110 nt, H. sapiens
ccgccccgggccgcggcuccugauuguccaaacgcaauucucgagucuauggcuccggccgagaguugagucuggacgucccgagccgccgcccccaaaccucgagcggg

SEQ ID NO: 132 - RNA, 110 nt, H. sapiens
cauuuccaagcacgauuagcauuugaggugaaguucuguuauacacucaggcuguggcucucugaaagucagugcaucacagaacuuugucucgaaagcuuucuagcagc

SEQ ID NO: 133 - RNA, 110 nt, H. sapiens
ggggaggcacuggcaggccugcccgacacucuuucccuguugcacuacuauaggccgcugggaagcagugcaaugaugaaagggcaucggucagguccagccugcuaccc

SEQ ID NO: 134 - RNA, 110 nt, H. sapiens
ccuguuacugaacacuguucuaugguuaguuuugcagguuugcauccagcugugugauauucugcugugcaaauccaugcaaaacugacugugguagugaaaagucugua

SEQ ID NO: 135 - RNA, 110 nt, H. sapiens
uugugacugcaugcucccagguugagguaguagguuguauaguuuagaauuacaucaagggagauaacuguacagccuccuagcuuuccuugggucuugcacuaaacaac

SEQ ID NO: 136 - RNA, 110 nt, H. sapiens
gauggcugugaguuggcuuaaucucagcuggcaacugugagauguucauacaaucccucacaguggucucugggauuaugcuaaacagagcaauuuccuagcccucacga

SEQ ID NO: 137 - RNA, 110 nt, H. sapiens
aaagagagaagauauugaggccuguugccacaaacccguagauccgaacuugugguauuaguccgcacaagcuuguaucuauagguaugugucuguuaggcaaucucacg

SEQ ID NO: 138 - skipped

SEQ ID NO: 139 - RNA, 110 nt, H. sapiens
ggucgggcucaccaugacacagugugagaccucgggcuacaacacaggacccggggcgcugcucugaccccucgugucuuguguugcagccggagggacgcagguccgca

SEQ ID NO: 140 - RNA, 110 nt, H. sapiens
guucaacauaagcaaacagauuguaaacuggcugauaauuuuuguacugacaaugucauuuacagcugucagccuuucgucugccuuguuugcuuuauucaaauaugaac

SEQ ID NO: 141 - RNA, 110 nt, H. sapiens
cccuccaaugucugauuaaucaagccugcaaacagcuuauuucuuuuagccugcaugcaaguaugaaaaugagauucugggagccgaacauggugcagauuuguucauuc

SEQ ID NO: 142 - RNA, 110 nt, H. sapiens
ccccuccaaugucugauuaaucaagccugcaaacagcuuauuucuuuuagccugcaugcaaguaugaaaaugagauucugggagccgaacauggugcagauuuguucauu

SEQ ID NO: 143 - RNA, 110 nt, H. sapiens
cccgccccagcccugagggccccucugcguguucacagcggaccuugauuuaaugucuauacaauuaaggcacgcggugaaugccaagagaggcgccuccgccgcuccuu

SEQ ID NO: 144 - RNA, 110 nt, H. sapiens
cuggauacagaguggaccggcuggccccaucuggaagacuagugauuuuguuguugucuuacugcgcucaacaacaaaucccagucuaccuaauggugccagccaucgca

SEQ ID NO: 145 - RNA, 110 nt, H. sapiens
ggggugaauuuauuucuuacagaaccgcccugauucagauggugcaagccucgcaggccagaaacaucuuccugacgcugcuccccaccuucugcccucucuuucccagc

SEQ ID NO: 146 - RNA, 110 nt, H. sapiens
gcugaugaaaauagggcagugguuuaaauagauuugcaagcaauuuaccuuuucacaauguuggcaaucugaugcaauuugcuugcaauuuugucugcuuucaguagcac

SEQ ID NO: 147 - RNA, 110 nt, H. sapiens
cacgcaugagcggacgcuaacccccuccccagccacaaagagucuacaugucuagggucuagacauguucagcuuuguggaccuccggcuccugcuccucuuagcggcca

SEQ ID NO: 148 - RNA, 110 nt, H. sapiens
acccggcagugccuccaggcgcagggcagccccugcccaccgcacacugcgcugccccagacccacugugcgugugacagcggcugaucugugccugggcagcgcgaccc

SEQ ID NO: 149 - RNA, 110 nt, H. sapiens
aucauucagaaaugguauacaggaaaaugaccuaugaauugacagacaauauagcugaguuugucugucauuucuuuaggccaauauucuguaugacugugcuacuucaa

SEQ ID NO: 150 - RNA, 110 nt, H. sapiens
ccuggccuccugcagugccacgcuccguguauuugacaagcugaguuggacacuccaugugguagagugucaguuugucaaauaccccaagugcggcacaugcuuaccag

SEQ ID NO: 151 - RNA, 110 nt, H. sapiens
cacggcgcggcagcggcacuggcuaagggaggcccguuucucucuuugguuaucuagcuguaugagugccacagagccgucauaaagcuagauaaccgaaaguagaaaug

SEQ ID NO: 152 - RNA, 110 nt, H. sapiens
uggauagccggccccgccaacccaguguucagacuaccuguucaggaggcucucaauguguacaguagucugcacauugguuaggcugggcuugggugagcggcucgucg

SEQ ID NO: 153 - RNA, 110 nt, H. sapiens
ccuagagagcacugagcgacagauacuguaaacauccuacacucucagcuguggaaaguaagaaagcugggagaaggcuguuuacucuuucugccuuggaagucaacuaa

SEQ ID NO: 154 - RNA, 110 nt, H. sapiens
aggcugcccuggcucaguuaucacagugcugaugcugucuauucuaaagguacaguacugugauaacugaaggauggcagccaucuuaccuuccaucagaggagccucac

SEQ ID NO: 155 - skipped

SEQ ID NO: 156 - RNA, 110 nt, H. sapiens
uguugaaugcaagcagaugcugauaauaucagaagucacagcauaauuuuuuuugaucaaagggcucaagugagccugaugaagcaugcaucuugcucgucuuugauaaa

SEQ ID NO: 157 - RNA, 110 nt, H. sapiens
ccugcagugaugcuucaugagcaaaucacaugaugucagaaugguaugguuucgauuuaaucaagaaagagauuaaaguggauguguguuauuuucaacuucgcagcagc

SEQ ID NO: 158 - RNA, 110 nt, H. sapiens
cgccccacccugcccgggacccaguucaaguaauucaggauagguugugugcuguccagccuguucuccauuacuuggcucggggaccggugcccugcagccuuggggug

SEQ ID NO: 159 - RNA, 110 nt, H. sapiens
ugcguuuacauaacaccaggcgugugggagcuggaggaagagguugcgaauguaggagagauaaggcuccugcuuucccuccuuccuucuuggugguaccaggcuugaca

SEQ ID NO: 160 - RNA, 110 nt, H. sapiens
ggcccgcugucccccccggcccagguucugugauacacuccgacucgggcucuggagcagucagugcaugacagaacuugggcccggaaggaccuucugcacccaacggg

SEQ ID NO: 161 - RNA, 110 nt, H. sapiens
cagccccaggccucgcuguucucuauggcuuuuuauuccuaugugauucuacugcucacucauauagggauuggagccguggcgcacggcggggacagccagcggagggu

SEQ ID NO: 162 - RNA, 110 nt, H. sapiens
accaagauaaauucacucuagugcuuuauggcuuuuuauuccuaugugauaguaauaaagucucauguagggauggaagccaugaaauacauugugaaaaaucaucaacu

SEQ ID NO: 163 - RNA, 110 nt, H. sapiens
aguauaauuauuacauaguuuuugaugucgcagauacugcaucaggaacugauuggauaagaaucagucaccaucaguuccuaaugcauugccuucagcaucuaaacaag

SEQ ID NO: 164 - RNA, 110 nt, H. sapiens
cuuggccauaaacuuguagucauccucuauccaaucauauugucuugaguaauuaaaaugauuagcuuaauuagcuuaauuaacuaaauuugacuacaggacauggccau

SEQ ID NO: 165 - RNA, 110 nt, H. sapiens
ggcgcgaauguguguuuaaaaaaaauaaaaccuuggaguaaaguagcagcacauaaugguuuguggauuuugaaaaggugcaggccauauugugcugccucaaaaauaca

SEQ ID NO: 166 - RNA, 110 nt, H. sapiens
uuugccugauuccaggcugagguaguaguuuguacaguuugagggucuaugauaccacccgguacaggagauaacuguacaggccacugccuugccaggaacagcgcgcc

SEQ ID NO: 167 - RNA, 110 nt, H. sapiens
aauuguccuugguuuuacaaugauaaaugaaaaacauuaaaauucuccaacugaacagguaugcaaggauuuuuauguuuuguuguuguuguuaaaacagugagagcaaa

SEQ ID NO: 168 - RNA, 110 nt, H. sapiens
gggggccgagagaggcgggcggccccgcggugcauugcuguugcauugcacgugugugaggcgggugcagugccucggcagugcagcccggagccggccccuggcaccac

SEQ ID NO: 169 - RNA, 110 nt, H. sapiens
gcaguggcgcucaaugcugugcacuuccaguugcagcaccuguaagguuuguuaaagguaaaggcaggucgggaaaaggugcuucgaggaagaggccugggagggggcga

SEQ ID NO: 170 - RNA, 110 nt, H. sapiens
gcaaugucagcagugccuuagcagcacguaaauauuggcguuaagauucuaaaauuaucuccaguauuaacugugcugcugaaguaagguugaccauacucuacaguugu

SEQ ID NO: 171 - RNA, 110 nt, H. sapiens
auggacaagaucuaugacggccaaguggaggugacuggcgauaaauacaauguggaaaguacugauggucagccaggugccuucaccugcuguauggaugcaggucuugc

SEQ ID NO: 172 - RNA, 110 nt, H. sapiens
cacuggaggcuguucuauaaaugaucauugaagggcugcaagcuagccuauaauuacaggaaagaaaguggcagcucuggcauuucauaacuauguguccucgaaaagug

SEQ ID NO: 173 - RNA, 110 nt, H. sapiens
gaauguaugaucuugcucuaacacuuggccagaccugugucacccacugcuagugccugaagucgacagacaauucugccaagguaaccgagaaucauuaagcauccugc

SEQ ID NO: 174 - RNA, 110 nt, H. sapiens
cacccugucugacaaguauguuuuaucguuucaagaaaugcgguuaaccucgcaguacuaaaacugaaugaacaaggccuguuggacaaauugaaaaacaaaugguggua

SEQ ID NO: 175 - RNA, 110 nt, H. sapiens
uguuuuuuugaguacauguguauaaauagagguggcuuccugucaguuugguauuauugauaugauccaacugcaagaaguuacugcaacacuuugcaucuuaaaggucc

SEQ ID NO: 176 - RNA, 110 nt, H. sapiens
uaguucagcacucuuaccucuuauugguguaccaccuggguggauaauaugaaugcaaauaagauuagaaagaagaagcauuaguacgagaagaaggaggcuagggcugg

SEQ ID NO: 177 - RNA, 110 nt, H. sapiens
gagcugcuugccuccccccguuuuuggcaaugguagaacucacacuggugagguaacaggauccggugguucuagacuugccaacuauggggcgaggacucagccggcac

SEQ ID NO: 178 - RNA, 110 nt, H. sapiens
cuugccagaaacaucagugacauggacaaaggugucauugaaggagacaaagauguggcaggcaccaaauacauucucuccuucaaccaccugagguccgaggcugauga

SEQ ID NO: 179 - RNA, 110 nt, H. sapiens
uggaaggaaaauaggaguuugauaugacauauugugugucucagcaagacucauaaauaauuuugacaaguuuuuguaugcaugggaaaguccuugauucagccucccau

SEQ ID NO: 180 - RNA, 110 nt, H. sapiens
gggaaccagcgcuuucaguaagagagugguaccacgugucuucaaaaugaaacguuucuuggagacaaacaugcuacucucacugaguacacaagcuuccugguugucag

SEQ ID NO: 181 - RNA, 110 nt, H. sapiens
ccaguuuccaucugucaugauagccuaucuccgaaccuucaaucugucaaaagcucgcugccuggcugaaggcuccaggagauuuggugcacuaaacacauuugacaaca

SEQ ID NO: 182 - RNA, 110 nt, H. sapiens
aaugccagugaguuugaaaggcacuuuguccaauuagaaguguggagaaauauucauccuguccaugacaaagaugaagugcuucuuucaaaagcggcgguggcaggcug

SEQ ID NO: 183 - RNA, 110 nt, H. sapiens
agcacuucuacaugauccuaugacucuugauauggacgcaguccugucagacuuuguucgguccacgggggcagaaccuggucuggccagagaccugcuggaagguaagc

SEQ ID NO: 184 - RNA, 110 nt, H. sapiens
uugugcaccucaccugcucuggaaguaguuugcuagcucugaugcuucaugguucagacuccucaggugcacgauuaaauuuccagaguuggugaacauggcgccacaug

SEQ ID NO: 185 - RNA, 110 nt, H. sapiens
ggaggaagacagcacguuuggucuuuugaggcaaaguucugagacacuccgacucugaguaugauagaagucagugcacuacagaacuuugucucuagaggcuguggucg

SEQ ID NO: 186 - RNA, 110 nt, H. sapiens
acuccaggugaaacacugcugaguccuuuggugaugugugguccccauggccucaaguuccugaagccuguggagcugcgcuuaccacacugugcguccaugacuccuga

SEQ ID NO: 187 - RNA, 110 nt, H. sapiens
cucaccccugugccacggccggcugggguuccuggggaugggauuugcuuccugucacaaaucacauugccagggauuuccaaccgacccugagcucugccaccgaggau

SEQ ID NO: 188 - RNA, 110 nt, H. sapiens
acacaaaacaugaacuguguacucauugucuucgcugcacagcuuggcauugggguuggugacucugauggccagcugagcagcucuuuccacaauggcuuugugguccu

SEQ ID NO: 189 - RNA, 110 nt, H. sapiens
auaugggaaccagugcuugcagaaagaggguaguuccacaugucugcaaaacgagacaucucuugaagacaaacaugcuacucucacugcguacauaagcuuccuauuug

SEQ ID NO: 190 - RNA, 110 nt, H. sapiens
cggaaaauuugccaaggguuugggggaacauucaaccugucggugaguuugggcagcucaggcaaaccaucgaccguugaguggacccugaggccuggaauugccauccu

SEQ ID NO: 191 - RNA, 110 nt, H. sapiens
agaaugguaucauaggacagugugauggaauuuuucuuucucugucaucauuaaggggguucccccuauggugaggggaaugaaaaguacgauuuaauguucucuggaga

SEQ ID NO: 192 - RNA, 21 nt, H. sapiens
agugguuuuacccuaugguag

SEQ ID NO: 193 - RNA, 22 nt, H. sapiens
cuuucagucggauguuugcagc

SEQ ID NO: 194 - RNA, 22 nt, H. sapiens
uggcagugucuuagcugguugu

SEQ ID NO: 195 - RNA, 23 nt, H. sapiens
uagcaccauuugaaaucaguguu

SEQ ID NO: 196 - RNA, 22 nt, H. sapiens
uagcagcacguaaauauuggcg

SEQ ID NO: 197 - RNA, 22 nt, H. sapiens
gugaaauguuuaggaccacuag

SEQ ID NO: 198 - RNA, 21 nt, H. sapiens
uggaagacuagugauuuuguu

SEQ ID NO: 199 - RNA, 22 nt, H. sapiens
uacccuguagaaccgaauuugu

SEQ ID NO: 200 - RNA, 22 nt, H. sapiens
ucacagugaaccggucucuuuu

SEQ ID NO: 201 - RNA, 20 nt, H. sapiens
uugcauagucacaaaaguga

SEQ ID NO: 202 - RNA, 20 nt, H. sapiens
uucacaguggcuaaguucug

SEQ ID NO: 203 - RNA, 22 nt, H. sapiens
uuuggcacuagcacauuuuugc

SEQ ID NO: 204 - RNA, 24 nt, H. sapiens
caaagugcuuacagugcagguagu

SEQ ID NO: 205 - RNA, 21 nt, H. sapiens
cauuauuacuuuugguacgcg

SEQ ID NO: 206 - RNA, 23 nt, H. sapiens
uaacagucuacagccauggucgc

SEQ ID NO: 207 - RNA, 21 nt, H. sapiens
auaaggauuuuuaggggcauu

SEQ ID NO: 208 - RNA, 23 nt, H. sapiens
aucacauugccagggauuaccac

SEQ ID NO: 209 - RNA, 19 nt, H. sapiens
ugagguaguaguuugugcu

SEQ ID NO: 210 - RNA, 21 nt, H. sapiens
uaacagucuccagucacggcc

SEQ ID NO: 211 - RNA, 21 nt, H. sapiens
uaaagcuagauaaccgaaagu

SEQ ID NO: 212 - RNA, 22 nt, H. sapiens
ugagguaguagguugugugguu

SEQ ID NO: 213 - RNA, 22 nt, H. sapiens
uggaauguaaagaaguauguau

SEQ ID NO: 214 - RNA, 23 nt, H. sapiens
uggagugugacaaugguguuugu

SEQ ID NO: 215 - RNA, 22 nt, H. sapiens
aagcugccaguugaagaacugu

SEQ ID NO: 216 - RNA, 22 nt, H. sapiens
uauugcacuugucccggccugu

SEQ ID NO: 217 - RNA, 20 nt, H. sapiens
cauaaaguagaaagcacuac

SEQ ID NO: 218 - RNA, 23 nt, H. sapiens
uauggcacugguagaauucacug

SEQ ID NO: 219 - RNA, 21 nt, H. sapiens
acagcaggcacagacaggcag

SEQ ID NO: 220 - RNA, 22 nt, H. sapiens
ugagaugaagcacuguagcuca

SEQ ID NO: 221 - RNA, 21 nt, H. sapiens
cugaccuaugaauugacagcc

SEQ ID NO: 222 - RNA, 22 nt, H. sapiens
ugagguaguagguuguauaguu

SEQ ID NO: 223 - RNA, 23 nt, H. sapiens
aacauucaacgcugucggugagu

SEQ ID NO: 224 - RNA, 22 nt, H. sapiens
uccuucauuccaccggagucug

SEQ ID NO: 225 - RNA, 23 nt, H. sapiens
agcagcauuguacagggcuauga

SEQ ID NO: 226 - RNA, 22 nt, H. sapiens
uucaaguaauccaggauaggcu

SEQ ID NO: 227 - RNA, 19 nt, H. sapiens
gugcauuguaguugcauug

SEQ ID NO: 228 - RNA, 22 nt, H. sapiens
uagguaguuucauguuguuggg

SEQ ID NO: 229 - RNA, 23 nt, H. sapiens
agcagcauuguacagggcuauca

SEQ ID NO: 230 - RNA, 24 nt, H. sapiens
aaaagugcuuacagugcagguagc

SEQ ID NO: 231 - RNA, 22 nt, H. sapiens
ugagguaguagauuguauaguu

SEQ ID NO: 232 - RNA, 22 nt, H. sapiens
cuagcaccauuugaaaucgguu

SEQ ID NO: 233 - RNA, 20 nt, H. sapiens
cagugcaauguuaaaagggc

SEQ ID NO: 234 - RNA, 21 nt, H. sapiens
uugugcuugaucuaaccaugu

SEQ ID NO: 235 - RNA, 22 nt, H. sapiens
uuaaggcacgcggugaaugcca

SEQ ID NO: 236 - RNA, 22 nt, H. sapiens
uagcuuaucagacugauguuga

SEQ ID NO: 237 - RNA, 22 nt, H. sapiens
uacaguauagaugauguacuag

SEQ ID NO: 238 - RNA, 23 nt, H. sapiens
agcuacauugucugcuggguuuc

SEQ ID NO: 239 - RNA, 24 nt, H. sapiens
agcuacaucuggcuacugggucuc

SEQ ID NO: 240 - RNA, 22 nt, H. sapiens
uguaaacauccccgacuggaag

SEQ ID NO: 241 - RNA, 23 nt, H. sapiens
ugugcaaauccaugcaaaacuga

SEQ ID NO: 242 - RNA, 22 nt, H. sapiens
ucacagugaaccggucucuuuc

SEQ ID NO: 243 - RNA, 21 nt, H. sapiens
cuuuuugcggucugggcuugc

SEQ ID NO: 244 - RNA, 21 nt, H. sapiens
uugguccccuucaaccagcua

SEQ ID NO: 245 - RNA, 21 nt, H. sapiens
agagguaguagguugcauagu

SEQ ID NO: 246 - RNA, 22 nt, H. sapiens
uagcagcacaucaugguuuaca

SEQ ID NO: 247 - RNA, 22 nt, H. sapiens
cuagcaccaucugaaaucgguu

SEQ ID NO: 248 - RNA, 23 nt, H. sapiens
cccaguguuuagacuaucuguuc

SEQ ID NO: 249 - RNA, 21 nt, H. sapiens
ugagguaggagguuguauagu

SEQ ID NO: 250 - RNA, 22 nt, H. sapiens
ugagguaguagguuguaugguu

SEQ ID NO: 251 - RNA, 22 nt, H. sapiens
uucccuuugucauccuaugccu

SEQ ID NO: 252 - RNA, 24 nt, H. sapiens
guccaguuuucccaggaaucccuu

SEQ ID NO: 253 - RNA, 22 nt, H. sapiens
accaucgaccguugauuguacc

SEQ ID NO: 254 - RNA, 23 nt, H. sapiens
uaaagugcuuauagugcagguag

SEQ ID NO: 255 - RNA, 22 nt, H. sapiens
uugguccccuucaaccagcugu

SEQ ID NO: 256 - RNA, 17 nt, H. sapiens
agcugguguugugaauc

SEQ ID NO: 257 - RNA, 22 nt, H. sapiens
ugagguaguaaguuguauuguu

SEQ ID NO: 258 - RNA, 22 nt, H. sapiens
ucccugagacccuaacuuguga

SEQ ID NO: 259 - RNA, 23 nt, H. sapiens
cccaguguucagacuaccuguuc

SEQ ID NO: 260 - RNA, 24 nt, H. sapiens
aacauucauugcugucgguggguu

SEQ ID NO: 261 - RNA, 21 nt, H. sapiens
aacacugucugguaaagaugg

SEQ ID NO: 262 - RNA, 22 nt, H. sapiens
uaaggugcaucuagugcagaua

SEQ ID NO: 263 - RNA, 21 nt, H. sapiens
ccacaccguaucugacacuuu

SEQ ID NO: 264 - RNA, 22 nt, H. sapiens
uggcucaguucagcaggaacag

SEQ ID NO: 265 - RNA, 20 nt, H. sapiens
uacaguacugugauaacuga

SEQ ID NO: 266 - RNA, 21 nt, H. sapiens
uguaaacauccuacacucagc

SEQ ID NO: 267 - RNA, 23 nt, H. sapiens
uacccuguagauccgaauuugug

SEQ ID NO: 268 - RNA, 23 nt, H. sapiens
ugugcaaaucuaugcaaaacuga

SEQ ID NO: 269 - RNA, 22 nt, H. sapiens
uagcagcacauaaugguuugug

SEQ ID NO: 270 - RNA, 22 nt, H. sapiens
uauugcuuaagaauacgcguag

SEQ ID NO: 271 - RNA, 21 nt, H. sapiens
ugauuguccaaacgcaauucu

SEQ ID NO: 272 - RNA, 22 nt, H. sapiens
ucagugcaucacagaacuuugu

SEQ ID NO: 273 - RNA, 20 nt, H. sapiens
cagugcaaugaugaaagggc

SEQ ID NO: 274 - RNA, 21 nt, H. sapiens
uaaucucagcuggcaacugug

SEQ ID NO: 275 - RNA, 22 nt, H. sapiens
aacccguagauccgaacuugug

SEQ ID NO: 276 - RNA, 22 nt, H. sapiens
ucgugucuuguguugcagccgg

SEQ ID NO: 277 - RNA, 21 nt, H. sapiens
cugugcgugugacagcggcug

SEQ ID NO: 278 - RNA, 21 nt, H. sapiens
augaccuaugaauugacagac

SEQ ID NO: 279 - RNA, 21 nt, H. sapiens
ugucaguuugucaaauacccc

SEQ ID NO: 280 - RNA, 23 nt, H. sapiens
uguaaacauccuacacucucagc

SEQ ID NO: 281 - RNA, 22 nt, H. sapiens
uucaaguaauucaggauagguu

SEQ ID NO: 282 - RNA, 21 nt, H. sapiens
ucagugcaugacagaacuugg

SEQ ID NO: 283 - RNA, 24 nt, H. sapiens
uauggcuuuuuauuccuaugugau

SEQ ID NO: 284 - RNA, 24 nt, H. sapiens
uacugcaucaggaacugauuggau

SEQ ID NO: 285 - RNA, 21 nt, H. sapiens
ugagguaguaguuuguacagu

SEQ ID NO: 286 - RNA, 19 nt, H. sapiens
gugcauugcuguugcauug

SEQ ID NO: 287 - RNA, 22 nt, H. sapiens
uuuggcaaugguagaacucaca

SEQ ID NO: 288 - RNA, 22 nt, H. sapiens
ucagugcacuacagaacuuugu

SEQ ID NO: 289 - RNA, 21 nt, H. sapiens
aucacauugccagggauuucc

SEQ ID NO: 290 - RNA, 22 nt, H. sapiens
aacauucaaccugucggugagu

SEQ ID NO: 291 - DNA, 21 bp, Artificial Sequence
  Oligomeric compound
ctaccatagggtaaaaccact

SEQ ID NO: 292 - DNA, 22 bp, Artificial Sequence
  Oligomeric compound
gctgcaaacatccgactgaaag

SEQ ID NO: 293 - DNA, 22 bp, Artificial Sequence
  Oligomeric compound
acaaccagctaagacactgcca

SEQ ID NO: 294 - DNA, 23 bp, Artificial Sequence
  Oligomeric compound
aacactgatttcaaatggtgcta

SEQ ID NO: 295 - DNA, 22 bp, Artificial Sequence
  Oligomeric compound
cgccaatatttacgtgctgcta

SEQ ID NO: 296 - DNA, 22 bp, Artificial Sequence
  Oligomeric compound
ctagtggtcctaaacatttcac

SEQ ID NO: 297 - DNA, 21 bp, Artificial Sequence
  Oligomeric compound
aacaaaatcactagtcttcca

SEQ ID NO: 298 - DNA, 22 bp, Artificial Sequence
  Oligomeric compound
acaaattcggttctacagggta

SEQ ID NO: 299 - DNA, 22 bp, Artificial Sequence
  Oligomeric compound
aaaagagaccggttcactgtga

SEQ ID NO: 300 - DNA, 20 bp, Artificial Sequence
  Oligomeric compound
tcacttttgtgactatgcaa

SEQ ID NO: 301 - DNA, 20 bp, Artificial Sequence
  Oligomeric compound
cagaacttagccactgtgaa

SEQ ID NO: 302 - DNA, 22 bp, Artificial Sequence
  Oligomeric compound
gcaaaaatgtgctagtgccaaa

SEQ ID NO: 303 - DNA, 24 bp, Artificial Sequence
  Oligomeric compound
actacctgcactgtaagcactttg

SEQ ID NO: 304 - DNA, 21 bp, Artificial Sequence
  Oligomeric compound
cgcgtaccaaaagtaataatg

SEQ ID NO: 305 - DNA, 23 bp, Artificial Sequence
  Oligomeric compound
gcgaccatggctgtagactgtta

SEQ ID NO: 306 - DNA, 21 bp, Artificial Sequence
  Oligomeric compound
aatgcccctaaaaatccttat

SEQ ID NO: 307 - DNA, 23 bp, Artificial Sequence
  Oligomeric compound
gtggtaatccctggcaatgtgat

SEQ ID NO: 308 - DNA, 19 bp, Artificial Sequence
  Oligomeric compound
agcacaaactactacctca

SEQ ID NO: 309 - DNA, 21 bp, Artificial Sequence
  Oligomeric compound
ggccgtgactggagactgtta

SEQ ID NO: 310 - DNA, 21 bp, Artificial Sequence
  Oligomeric compound
actttcggttatctagcttta

SEQ ID NO: 311 - DNA, 22 bp, Artificial Sequence
  Oligomeric compound
aaccacacaacctactacctca

SEQ ID NO: 312 - DNA, 22 bp, Artificial Sequence
  Oligomeric compound
atacatacttctttacattcca

SEQ ID NO: 313 - DNA, 23 bp, Artificial Sequence
  Oligomeric compound
acaaacaccattgtcacactcca

SEQ ID NO: 314 - DNA, 22 bp, Artificial Sequence
  Oligomeric compound
acagttcttcaactggcagctt

SEQ ID NO: 315 - DNA, 22 bp, Artificial Sequence
  Oligomeric compound
acaggccgggacaagtgcaata

SEQ ID NO: 316 - DNA, 20 bp, Artificial Sequence
  Oligomeric compound
gtagtgctttctactttatg

SEQ ID NO: 317 - DNA, 23 bp, Artificial Sequence
  Oligomeric compound
cagtgaattctaccagtgccata

SEQ ID NO: 318 - DNA, 21 bp, Artificial Sequence
  Oligomeric compound
ctgcctgtctgtgcctgctgt

SEQ ID NO: 319 - DNA, 22 bp, Artificial Sequence
  Oligomeric compound
tgagctacagtgcttcatctca

SEQ ID NO: 320 - DNA, 21 bp, Artificial Sequence
  Oligomeric compound
ggctgtcaattcataggtcag

SEQ ID NO: 321 - DNA, 22 bp, Artificial Sequence
  Oligomeric compound
aactatacaacctactacctca

SEQ ID NO: 322 - DNA, 23 bp, Artificial Sequence
  Oligomeric compound
actcaccgacagcgttgaatgtt

SEQ ID NO: 323 - DNA, 22 bp, Artificial Sequence
  Oligomeric compound
cagactccggtggaatgaagga

SEQ ID NO: 324 - DNA, 23 bp, Artificial Sequence
  Oligomeric compound
tcatagccctgtacaatgctgct

SEQ ID NO: 325 - DNA, 22 bp, Artificial Sequence
  Oligomeric compound
agcctatcctggattacttgaa

SEQ ID NO: 326 - DNA, 19 bp, Artificial Sequence
  Oligomeric compound
caatgcaactacaatgcac

SEQ ID NO: 327 - DNA, 22 bp, Artificial Sequence
  Oligomeric compound
cccaacaacatgaaactaccta

SEQ ID NO: 328 - DNA, 23 bp, Artificial Sequence
  Oligomeric compound
tgatagccctgtacaatgctgct

SEQ ID NO: 329 - DNA, 24 bp, Artificial Sequence
  Oligomeric compound
gctacctgcactgtaagcactttt

SEQ ID NO: 330 - DNA, 22 bp, Artificial Sequence
  Oligomeric compound
aactatacaatctactacctca

SEQ ID NO: 331 - DNA, 22 bp, Artificial Sequence
  Oligomeric compound
aaccgatttcaaatggtgctag

SEQ ID NO: 332 - DNA, 20 bp, Artificial Sequence
  Oligomeric compound
gcccttttaacattgcactg

SEQ ID NO: 333 - DNA, 21 bp, Artificial Sequence
  Oligomeric compound
acatggttagatcaagcacaa

SEQ ID NO: 334 - DNA, 22 bp, Artificial Sequence
  Oligomeric compound
tggcattcaccgcgtgccttaa

SEQ ID NO: 335 - DNA, 22 bp, Artificial Sequence
  Oligomeric compound
tcaacatcagtctgataagcta

SEQ ID NO: 336 - DNA, 22 bp, Artificial Sequence
  Oligomeric compound
ctagtacatcatctatactgta

SEQ ID NO: 337 - DNA, 23 bp, Artificial Sequence
  Oligomeric compound
gaaacccagcagacaatgtagct

SEQ ID NO: 338 - DNA, 24 bp, Artificial Sequence
  Oligomeric compound
gagacccagtagccagatgtagct

SEQ ID NO: 339 - DNA, 22 bp, Artificial Sequence
  Oligomeric compound
cttccagtcggggatgtttaca

SEQ ID NO: 340 - DNA, 23 bp, Artificial Sequence
  Oligomeric compound
tcagttttgcatggatttgcaca

SEQ ID NO: 341 - DNA, 22 bp, Artificial Sequence
  Oligomeric compound
gaaagagaccggttcactgtga

SEQ ID NO: 342 - DNA, 21 bp, Artificial Sequence
  Oligomeric compound
gcaagcccagaccgcaaaaag

SEQ ID NO: 343 - DNA, 21 bp, Artificial Sequence
  Oligomeric compound
tagctggttgaaggggaccaa

SEQ ID NO: 344 - DNA, 21 bp, Artificial Sequence
  Oligomeric compound
actatgcaacctactacctct

SEQ ID NO: 345 - DNA, 22 bp, Artificial Sequence
  Oligomeric compound
tgtaaaccatgatgtgctgcta

SEQ ID NO: 346 - DNA, 22 bp, Artificial Sequence
  Oligomeric compound
aaccgatttcagatggtgctag

SEQ ID NO: 347 - DNA, 23 bp, Artificial Sequence
  Oligomeric compound
gaacagatagtctaaacactggg

SEQ ID NO: 348 - DNA, 21 bp, Artificial Sequence
  Oligomeric compound
actatacaacctcctacctca

SEQ ID NO: 349 - DNA, 22 bp, Artificial Sequence
  Oligomeric compound
aaccatacaacctactacctca

SEQ ID NO: 350 - DNA, 22 bp, Artificial Sequence
  Oligomeric compound
aggcataggatgacaaagggaa

SEQ ID NO: 351 - DNA, 24 bp, Artificial Sequence
  Oligomeric compound
aagggattcctgggaaaactggac

SEQ ID NO: 352 - DNA, 22 bp, Artificial Sequence
  Oligomeric compound
ggtacaatcaacggtcgatggt

SEQ ID NO: 353 - DNA, 23 bp, Artificial Sequence
  Oligomeric compound
ctacctgcactataagcacttta

SEQ ID NO: 354 - DNA, 22 bp, Artificial Sequence
  Oligomeric compound
acagctggttgaaggggaccaa

SEQ ID NO: 355 - DNA, 17 bp, Artificial Sequence
  Oligomeric compound
gattcacaacaccagct

SEQ ID NO: 356 - DNA, 22 bp, Artificial Sequence
  Oligomeric compound
aacaatacaacttactacctca

SEQ ID NO: 357 - DNA, 22 bp, Artificial Sequence
  Oligomeric compound
tcacaagttagggtctcaggga

SEQ ID NO: 358 - DNA, 23 bp, Artificial Sequence
  Oligomeric compound
gaacaggtagtctgaacactggg

SEQ ID NO: 359 - DNA, 24 bp, Artificial Sequence
  Oligomeric compound
aacccaccgacagcaatgaatgtt

SEQ ID NO: 360 - DNA, 21 bp, Artificial Sequence
  Oligomeric compound
ccatctttaccagacagtgtt

SEQ ID NO: 361 - DNA, 22 bp, Artificial Sequence
  Oligomeric compound
tatctgcactagatgcacctta

SEQ ID NO: 362 - DNA, 21 bp, Artificial Sequence
  Oligomeric compound
aaagtgtcagatacggtgtgg

SEQ ID NO: 363 - DNA, 22 bp, Artificial Sequence
  Oligomeric compound
ctgttcctgctgaactgagcca

SEQ ID NO: 364 - DNA, 22 bp, Artificial Sequence
  Oligomeric compound
aggcgaaggatgacaaagggaa

SEQ ID NO: 365 - DNA, 20 bp, Artificial Sequence
  Oligomeric compound
tcagttatcacagtactgta

SEQ ID NO: 366 - DNA, 21 bp, Artificial Sequence
  Oligomeric compound
gctgagtgtaggatgtttaca

SEQ ID NO: 367 - DNA, 23 bp, Artificial Sequence
  Oligomeric compound
cacaaattcggatctacagggta

SEQ ID NO: 368 - DNA, 23 bp, Artificial Sequence
  Oligomeric compound
tcagttttgcatagatttgcaca

SEQ ID NO: 369 - DNA, 22 bp, Artificial Sequence
  Oligomeric compound
cacaaaccattatgtgctgcta

SEQ ID NO: 370 - DNA, 22 bp, Artificial Sequence
  Oligomeric compound
ctacgcgtattcttaagcaata

SEQ ID NO: 371 - DNA, 21 bp, Artificial Sequence
  Oligomeric compound
agaattgcgtttggacaatca

SEQ ID NO: 372 - DNA, 22 bp, Artificial Sequence
  Oligomeric compound
acaaagttctgtgatgcactga

SEQ ID NO: 373 - DNA, 20 bp, Artificial Sequence
  Oligomeric compound
gccctttcatcattgcactg

SEQ ID NO: 374 - DNA, 21 bp, Artificial Sequence
  Oligomeric compound
cacagttgccagctgagatta

SEQ ID NO: 375 - DNA, 22 bp, Artificial Sequence
  Oligomeric compound
cacaagttcggatctacgggtt

SEQ ID NO: 376 - DNA, 22 bp, Artificial Sequence
  Oligomeric compound
ccggctgcaacacaagacacga

SEQ ID NO: 377 - DNA, 21 bp, Artificial Sequence
  Oligomeric compound
cagccgctgtcacacgcacag

SEQ ID NO: 378 - DNA, 21 bp, Artificial Sequence
  Oligomeric compound
gtctgtcaattcataggtcat

SEQ ID NO: 379 - DNA, 21 bp, Artificial Sequence
  Oligomeric compound
ggggtatttgacaaactgaca

SEQ ID NO: 380 - DNA, 23 bp, Artificial Sequence
  Oligomeric compound
gctgagagtgtaggatgtttaca

SEQ ID NO: 381 - DNA, 22 bp, Artificial Sequence
  Oligomeric compound
aacctatcctgaattacttgaa

SEQ ID NO: 382 - DNA, 21 bp, Artificial Sequence
  Oligomeric compound
ccaagttctgtcatgcactga

SEQ ID NO: 383 - DNA, 24 bp, Artificial Sequence
  Oligomeric compound
atcacataggaataaaaagccata

SEQ ID NO: 384 - DNA, 24 bp, Artificial Sequence
  Oligomeric compound
atccaatcagttcctgatgcagta

SEQ ID NO: 385 - DNA, 21 bp, Artificial Sequence
  Oligomeric compound
actgtacaaactactacctca

SEQ ID NO: 386 - DNA, 19 bp, Artificial Sequence
  Oligomeric compound
caatgcaacagcaatgcac

SEQ ID NO: 387 - DNA, 22 bp, Artificial Sequence
  Oligomeric compound
tgtgagttctaccattgccaaa

SEQ ID NO: 388 - DNA, 22 bp, Artificial Sequence
  Oligomeric compound
acaaagttctgtagtgcactga

SEQ ID NO: 389 - DNA, 21 bp, Artificial Sequence
  Oligomeric compound
ggaaatccctggcaatgtgat

SEQ ID NO: 390 - DNA, 22 bp, Artificial Sequence
  Oligomeric compound
actcaccgacaggttgaatgtt

SEQ ID NO: 391 - DNA, 21 bp, Artificial Sequence
  Oligomeric compound
actgtaggaatatgtttgata

SEQ ID NO: 392 - DNA, 21 bp, Artificial Sequence
  Oligomeric compound
attaaaaagtcctcttgccca

SEQ ID NO: 393 - DNA, 21 bp, Artificial Sequence
  Oligomeric compound
gctgccgtatatgtgatgtca

SEQ ID NO: 394 - DNA, 21 bp, Artificial Sequence
  Oligomeric compound
ggtaggtggaatactataaca

SEQ ID NO: 395 - DNA, 21 bp, Artificial Sequence
  Oligomeric compound
taaacatcactgcaagtctta

SEQ ID NO: 396 - DNA, 21 bp, Artificial Sequence
  Oligomeric compound
ttgtaagcagttttgttgaca

SEQ ID NO: 397 - DNA, 21 bp, Artificial Sequence
  Oligomeric compound
tcacagagaaaacaactggta

SEQ ID NO: 398 - DNA, 21 bp, Artificial Sequence
  Oligomeric compound
cctctcaaagatttcctgtca

SEQ ID NO: 399 - DNA, 21 bp, Artificial Sequence
  Oligomeric compound
tgtcagataaacagagtggaa

SEQ ID NO: 400 - DNA, 21 bp, Artificial Sequence
  Oligomeric compound
gagaatcaatagggcatgcaa

SEQ ID NO: 401 - DNA, 21 bp, Artificial Sequence
  Oligomeric compound
aagaacattaagcatctgaca

SEQ ID NO: 402 - DNA, 21 bp, Artificial Sequence
  Oligomeric compound
aatctctgcaggcaaatgtga

SEQ ID NO: 403 - DNA, 21 bp, Artificial Sequence
  Oligomeric compound
aaacccctatcacgattagca

SEQ ID NO: 404 - DNA, 21 bp, Artificial Sequence
  Oligomeric compound
gccccattaatattttaacca

SEQ ID NO: 405 - DNA, 19 bp, Artificial Sequence
  Oligomeric compound
cccaatatcaaacatatca

SEQ ID NO: 406 - DNA, 21 bp, Artificial Sequence
  Oligomeric compound
tatgatagcttccccatgtaa

SEQ ID NO: 407 - DNA, 21 bp, Artificial Sequence
  Oligomeric compound
cctcaattattggaaatcaca

SEQ ID NO: 408 - DNA, 21 bp, Artificial Sequence
  Oligomeric compound
attgatgcgccatttggccta

SEQ ID NO: 409 - DNA, 21 bp, Artificial Sequence
  Oligomeric compound
ctgtgacttctctatctgcct

SEQ ID NO: 410 - DNA, 21 bp, Artificial Sequence
  Oligomeric compound
aaacttgttaattgactgtca

SEQ ID NO: 411 - DNA, 21 bp, Artificial Sequence
  Oligomeric compound
aaagaagtatatgcataggaa

SEQ ID NO: 412 - DNA, 21 bp, Artificial Sequence
  Oligomeric compound
gataaagccaataaactgtca

SEQ ID NO: 413 - DNA, 21 bp, Artificial Sequence
  Oligomeric compound
tccgagtcggaggaggaggaa

SEQ ID NO: 414 - DNA, 21 bp, Artificial Sequence
  Oligomeric compound
atcattactggattgctgtaa

SEQ ID NO: 415 - DNA, 21 bp, Artificial Sequence
  Oligomeric compound
caaaaattatcagccagttta

SEQ ID NO: 416 - DNA, 21 bp, Artificial Sequence
  Oligomeric compound
aatctcattttcatacttgca

SEQ ID NO: 417 - DNA, 21 bp, Artificial Sequence
  Oligomeric compound
agaaggtggggagcagcgtca

SEQ ID NO: 418 - DNA, 21 bp, Artificial Sequence
  Oligomeric compound
caaaattgcaagcaaattgca

SEQ ID NO: 419 - DNA, 21 bp, Artificial Sequence
  Oligomeric compound
tccacaaagctgaacatgtct

SEQ ID NO: 420 - DNA, 21 bp, Artificial Sequence
  Oligomeric compound
tattatcagcatctgcttgca

SEQ ID NO: 421 - DNA, 21 bp, Artificial Sequence
  Oligomeric compound
aataacacacatccactttaa

SEQ ID NO: 422 - DNA, 21 bp, Artificial Sequence
  Oligomeric compound
aagaaggaaggagggaaagca

SEQ ID NO: 423 - DNA, 21 bp, Artificial Sequence
  Oligomeric compound
atgactacaagtttatggcca

SEQ ID NO: 424 - DNA, 21 bp, Artificial Sequence
  Oligomeric compound
caaaacataaaaatccttgca

SEQ ID NO: 425 - DNA, 21 bp, Artificial Sequence
  Oligomeric compound
ttacaggtgctgcaactggaa

SEQ ID NO: 426 - DNA, 21 bp, Artificial Sequence
  Oligomeric compound
agcaggtgaaggcacctggct

SEQ ID NO: 427 - DNA, 21 bp, Artificial Sequence
  Oligomeric compound
tatgaaatgccagagctgcca

SEQ ID NO: 428 - DNA, 21 bp, Artificial Sequence
  Oligomeric compound
ccaagtgttagagcaagatca

SEQ ID NO: 429 - DNA, 21 bp, Artificial Sequence
  Oligomeric compound
aacgataaaacatacttgtca

SEQ ID NO: 430 - DNA, 20 bp, Artificial Sequence
  Oligomeric compound
agtaacttcttgcagttgga

SEQ ID NO: 431 - DNA, 21 bp, Artificial Sequence
  Oligomeric compound
agcctccttcttctcgtacta

SEQ ID NO: 432 - DNA, 21 bp, Artificial Sequence
  Oligomeric compound
acctcaggtggttgaaggaga

SEQ ID NO: 433 - DNA, 21 bp, Artificial Sequence
  Oligomeric compound
atatgtcatatcaaactccta

SEQ ID NO: 434 - DNA, 21 bp, Artificial Sequence
  Oligomeric compound
gtgagagtagcatgtttgtct

SEQ ID NO: 435 - DNA, 21 bp, Artificial Sequence
  Oligomeric compound
tgaaggttcggagataggcta

SEQ ID NO: 436 - DNA, 21 bp, Artificial Sequence
  Oligomeric compound
aattggacaaagtgcctttca

SEQ ID NO: 437 - DNA, 21 bp, Artificial Sequence
  Oligomeric compound
accgaacaaagtctgacagga

SEQ ID NO: 438 - DNA, 21 bp, Artificial Sequence
  Oligomeric compound
aactacttccagagcaggtga

SEQ ID NO: 439 - DNA, 21 bp, Artificial Sequence
  Oligomeric compound
gtaagcgcagctccacaggct

SEQ ID NO: 440 - DNA, 21 bp, Artificial Sequence
  Oligomeric compound
gagctgctcagctggccatca

SEQ ID NO: 441 - DNA, 21 bp, Artificial Sequence
  Oligomeric compound
tacttttcattcccctcacca

SEQ ID NO: 442 - DNA, 20 bp, Artificial Sequence
  Oligomeric compound
agaacagcatgacgtaacct

SEQ ID NO: 443 - DNA, 20 bp, Artificial Sequence
  Oligomeric compound
gcccatctgtggcttcacag

SEQ ID NO: 444 - DNA, 20 bp, Artificial Sequence
  Oligomeric compound
gaagtccgaggcagtaggca

SEQ ID NO: 445 - DNA, 20 bp, Artificial Sequence
  Oligomeric compound
cttccttactattgctcaca

SEQ ID NO: 446 - DNA, 20 bp, Artificial Sequence
  Oligomeric compound
gctagatacaaagatggaaa

SEQ ID NO: 447 - DNA, 20 bp, Artificial Sequence
  Oligomeric compound
ctagacaatcactatttaaa

SEQ ID NO: 448 - DNA, 20 bp, Artificial Sequence
  Oligomeric compound
gcagcgcagctggtctcccc

SEQ ID NO: 449 - DNA, 20 bp, Artificial Sequence
  Oligomeric compound
taatatatatttcactacgc

SEQ ID NO: 450 - DNA, 20 bp, Artificial Sequence
  Oligomeric compound
tgctgtatccctgtcacact

SEQ ID NO: 451 - DNA, 20 bp, Artificial Sequence
  Oligomeric compound
caattgcgctacagaactgt

SEQ ID NO: 452 - DNA, 20 bp, Artificial Sequence
  Oligomeric compound
tcgatttagttatctaaaaa

SEQ ID NO: 453 - DNA, 20 bp, Artificial Sequence
  Oligomeric compound
ctgtagaggcatggcctgtg

SEQ ID NO: 454 - DNA, 20 bp, Artificial Sequence
  Oligomeric compound
tgactatacggataccacac

SEQ ID NO: 455 - DNA, 20 bp, Artificial Sequence
  Oligomeric compound
ggaacaaggccaattattgc

SEQ ID NO: 456 - DNA, 20 bp, Artificial Sequence
  Oligomeric compound
agaaatgtaaacctctcaga

SEQ ID NO: 457 - DNA, 20 bp, Artificial Sequence
  Oligomeric compound
agctgtgagggagagagaga

SEQ ID NO: 458 - DNA, 20 bp, Artificial Sequence
  Oligomeric compound
ctggagtgagaatactagct

SEQ ID NO: 459 - DNA, 20 bp, Artificial Sequence
  Oligomeric compound
actgggctcatattactagc

SEQ ID NO: 460 - DNA, 20 bp, Artificial Sequence
  Oligomeric compound
ttggattaaataacaaccta

SEQ ID NO: 461 - DNA, 20 bp, Artificial Sequence
  Oligomeric compound
cccggagacagggcaagaca

SEQ ID NO: 462 - DNA, 20 bp, Artificial Sequence
  Oligomeric compound
aaagcggaaaccaatcactg

SEQ ID NO: 463 - DNA, 20 bp, Artificial Sequence
  Oligomeric compound
gtccccatctcaccttctct

SEQ ID NO: 464 - DNA, 20 bp, Artificial Sequence
  Oligomeric compound
tcagagcggagagacacaag

SEQ ID NO: 465 - DNA, 20 bp, Artificial Sequence
  Oligomeric compound
tagatgcacatatcactacc

SEQ ID NO: 466 - DNA, 20 bp, Artificial Sequence
  Oligomeric compound
cttggcttcccgaggcagct

SEQ ID NO: 467 - DNA, 20 bp, Artificial Sequence
  Oligomeric compound
agtttgaagtgtcacagcgc

SEQ ID NO: 468 - DNA, 20 bp, Artificial Sequence
  Oligomeric compound
gcgttttcgatgcggtgccg

SEQ ID NO: 469 - DNA, 20 bp, Artificial Sequence
  Oligomeric compound
gagacgcgggggcggggcgc

SEQ ID NO: 470 - DNA, 20 bp, Artificial Sequence
  Oligomeric compound
tacctccagttcccacagta

SEQ ID NO: 471 - DNA, 20 bp, Artificial Sequence
  Oligomeric compound
tgtgttttctgactcagtca

SEQ ID NO: 472 - DNA, 20 bp, Artificial Sequence
  Oligomeric compound
agagcacctgagagcagcgc

SEQ ID NO: 473 - DNA, 20 bp, Artificial Sequence
  Oligomeric compound
tcttaagtcacaaatcagca

SEQ ID NO: 474 - DNA, 20 bp, Artificial Sequence
  Oligomeric compound
tctccacagcgggcaatgtc

SEQ ID NO: 475 - DNA, 20 bp, Artificial Sequence
  Oligomeric compound
ggcgcgctgtccgggcgggg

SEQ ID NO: 476 - DNA, 20 bp, Artificial Sequence
  Oligomeric compound
actgagggcggcccgggcag

SEQ ID NO: 477 - DNA, 20 bp, Artificial Sequence
  Oligomeric compound
gtcctcttgcccaagcaaca

SEQ ID NO: 478 - DNA, 20 bp, Artificial Sequence
  Oligomeric compound
gaagaccaatacactcatac

SEQ ID NO: 479 - DNA, 20 bp, Artificial Sequence
  Oligomeric compound
ccgaggggcaacatcactgc

SEQ ID NO: 480 - DNA, 20 bp, Artificial Sequence
  Oligomeric compound
tccatagcttagcaggtcca

SEQ ID NO: 481 - DNA, 20 bp, Artificial Sequence
  Oligomeric compound
tttgatagtttagacacaaa

SEQ ID NO: 482 - DNA, 20 bp, Artificial Sequence
  Oligomeric compound
gggaaggattgcctagcagt

SEQ ID NO: 483 - DNA, 20 bp, Artificial Sequence
  Oligomeric compound
agctttagctgggtcaggac

SEQ ID NO: 484 - DNA, 20 bp, Artificial Sequence
  Oligomeric compound
taccatacagaaacacagca

SEQ ID NO: 485 - DNA, 20 bp, Artificial Sequence
  Oligomeric compound
tcacaatccccaccaaactc

SEQ ID NO: 486 - DNA, 20 bp, Artificial Sequence
  Oligomeric compound
tcactcctaaaggttcaagt

SEQ ID NO: 487 - DNA, 20 bp, Artificial Sequence
  Oligomeric compound
caccctccagtgctgttagt

SEQ ID NO: 488 - DNA, 20 bp, Artificial Sequence
  Oligomeric compound
ctgactgagactgttcacag

SEQ ID NO: 489 - DNA, 20 bp, Artificial Sequence
  Oligomeric compound
cctttaggggttgccacacc

SEQ ID NO: 490 - DNA, 20 bp, Artificial Sequence
  Oligomeric compound
acaggtgagcggatgttctg

SEQ ID NO: 491 - DNA, 20 bp, Artificial Sequence
  Oligomeric compound
cagactcccaactgaccaga

SEQ ID NO: 492 - DNA, 20 bp, Artificial Sequence
  Oligomeric compound
agaggggagacgagagcact

SEQ ID NO: 493 - DNA, 20 bp, Artificial Sequence
  Oligomeric compound
tcacgtggagaggagttaaa

SEQ ID NO: 494 - DNA, 20 bp, Artificial Sequence
  Oligomeric compound
agtgctaatacttctttcat

SEQ ID NO: 495 - DNA, 20 bp, Artificial Sequence
  Oligomeric compound
acctgtgtaacagccgtgta

SEQ ID NO: 496 - DNA, 20 bp, Artificial Sequence
  Oligomeric compound
ttatcggaacttcacagaga

SEQ ID NO: 497 - DNA, 20 bp, Artificial Sequence
  Oligomeric compound
tcccatagcagggcagagcc

SEQ ID NO: 498 - DNA, 20 bp, Artificial Sequence
  Oligomeric compound
ggcacttcattgctgctgcc

SEQ ID NO: 499 - DNA, 20 bp, Artificial Sequence
  Oligomeric compound
ggagccttgcgctcagcatt

SEQ ID NO: 500 - DNA, 20 bp, Artificial Sequence
  Oligomeric compound
atggtaatttcatttcaggc

SEQ ID NO: 501 - DNA, 20 bp, Artificial Sequence
  Oligomeric compound
gattgcacatccacactgtc

SEQ ID NO: 502 - DNA, 20 bp, Artificial Sequence
  Oligomeric compound
gctggcctgatagcccttct

SEQ ID NO: 503 - DNA, 20 bp, Artificial Sequence
  Oligomeric compound
gttttttcaaatcccaaact

SEQ ID NO: 504 - DNA, 20 bp, Artificial Sequence
  Oligomeric compound
cccagtggtgggtgtgaccc

SEQ ID NO: 505 - DNA, 20 bp, Artificial Sequence
  Oligomeric compound
ctggttgggtatgagacaga

SEQ ID NO: 506 - DNA, 20 bp, Artificial Sequence
  Oligomeric compound
ttgatccatatgcaacaagg

SEQ ID NO: 507 - DNA, 20 bp, Artificial Sequence
  Oligomeric compound
gccattgggacctgcacagc

SEQ ID NO: 508 - DNA, 20 bp, Artificial Sequence
  Oligomeric compound
atgggtaccaccagaacatg

SEQ ID NO: 509 - DNA, 20 bp, Artificial Sequence
  Oligomeric compound
agttcaaaactcaatcccaa

SEQ ID NO: 510 - DNA, 20 bp, Artificial Sequence
  Oligomeric compound
gccctcgacgaaaaccgact

SEQ ID NO: 511 - DNA, 20 bp, Artificial Sequence
  Oligomeric compound
ttgaactccatgccacaagg

SEQ ID NO: 512 - DNA, 20 bp, Artificial Sequence
  Oligomeric compound
aggcctattcctgtagcaaa

SEQ ID NO: 513 - DNA, 20 bp, Artificial Sequence
  Oligomeric compound
gtagatctcaaaaagctacc

SEQ ID NO: 514 - DNA, 20 bp, Artificial Sequence
  Oligomeric compound
ctgaacagggtaaaatcact

SEQ ID NO: 515 - DNA, 20 bp, Artificial Sequence
  Oligomeric compound
agcaagtctactcctcaggg

SEQ ID NO: 516 - DNA, 20 bp, Artificial Sequence
  Oligomeric compound
aatggagccaaggtgctgcc

SEQ ID NO: 517 - DNA, 20 bp, Artificial Sequence
  Oligomeric compound
tagacaaaaacagactctga

SEQ ID NO: 518 - DNA, 20 bp, Artificial Sequence
  Oligomeric compound
gctagtgacaggtgcagaca

SEQ ID NO: 519 - DNA, 20 bp, Artificial Sequence
  Oligomeric compound
gggcctatccaaagtgacag

SEQ ID NO: 520 - DNA, 20 bp, Artificial Sequence
  Oligomeric compound
tacctctgcagtattctaca

SEQ ID NO: 521 - DNA, 20 bp, Artificial Sequence
  Oligomeric compound
tttactcatacctcgcaacc

SEQ ID NO: 522 - DNA, 20 bp, Artificial Sequence
  Oligomeric compound
aattgtatgacattaaatca

SEQ ID NO: 523 - DNA, 20 bp, Artificial Sequence
  Oligomeric compound
cttcaagtgcagccgtaggc

SEQ ID NO: 524 - DNA, 20 bp, Artificial Sequence
  Oligomeric compound
tgccatgagattcaacagtc

SEQ ID NO: 525 - DNA, 20 bp, Artificial Sequence
  Oligomeric compound
acattgctatcataagagct

SEQ ID NO: 526 - DNA, 20 bp, Artificial Sequence
  Oligomeric compound
taattttagaatcttaacgc

SEQ ID NO: 527 - DNA, 20 bp, Artificial Sequence
  Oligomeric compound
agtgtctcatcgcaaactta

SEQ ID NO: 528 - DNA, 20 bp, Artificial Sequence
  Oligomeric compound
tgttgcctaacgaacacaga

SEQ ID NO: 529 - DNA, 20 bp, Artificial Sequence
  Oligomeric compound
gctgattacgaaagacagga

SEQ ID NO: 530 - DNA, 20 bp, Artificial Sequence
  Oligomeric compound
gcttagctgtgtcttacagc

SEQ ID NO: 531 - DNA, 20 bp, Artificial Sequence
  Oligomeric compound
gaggatgtctgtgaatagcc

SEQ ID NO: 532 - DNA, 20 bp, Artificial Sequence
  Oligomeric compound
ccacatatacatatatacgc

SEQ ID NO: 533 - DNA, 20 bp, Artificial Sequence
  Oligomeric compound
aggaagcacacattatcaca

SEQ ID NO: 534 - DNA, 20 bp, Artificial Sequence
  Oligomeric compound
gacctgctactcactctcgt

SEQ ID NO: 535 - DNA, 20 bp, Artificial Sequence
  Oligomeric compound
ggttggccgcagactcgtac

SEQ ID NO: 536 - DNA, 20 bp, Artificial Sequence
  Oligomeric compound
gatgtcactgaggaaatcac

SEQ ID NO: 537 - DNA, 20 bp, Artificial Sequence
  Oligomeric compound
tcagttggaggcaaaaaccc

SEQ ID NO: 538 - DNA, 20 bp, Artificial Sequence
  Oligomeric compound
ggtagtgcagcgcagctggt

SEQ ID NO: 539 - DNA, 20 bp, Artificial Sequence
  Oligomeric compound
ccggctattgagttatgtac

SEQ ID NO: 540 - DNA, 20 bp, Artificial Sequence
  Oligomeric compound
acctctcaggaagacggact

SEQ ID NO: 541 - DNA, 20 bp, Artificial Sequence
  Oligomeric compound
gagcatgcaacactctgtgc

SEQ ID NO: 542 - DNA, 20 bp, Artificial Sequence
  Oligomeric compound
cctccttgtgggcaaaatcc

SEQ ID NO: 543 - DNA, 20 bp, Artificial Sequence
  Oligomeric compound
cgcatcttgactgtagcatg

SEQ ID NO: 544 - DNA, 20 bp, Artificial Sequence
  Oligomeric compound
tctaaggggtcacagaaggt

SEQ ID NO: 545 - DNA, 20 bp, Artificial Sequence
  Oligomeric compound
gaaaattatattgactctga

SEQ ID NO: 546 - DNA, 20 bp, Artificial Sequence
  Oligomeric compound
ggttcctaattaaacaaccc

SEQ ID NO: 547 - DNA, 20 bp, Artificial Sequence
  Oligomeric compound
ccgagggtctaacccagccc

SEQ ID NO: 548 - DNA, 20 bp, Artificial Sequence
  Oligomeric compound
gactactgttgagaggaaca

SEQ ID NO: 549 - DNA, 20 bp, Artificial Sequence
  Oligomeric compound
tctccttgggtgtcctcctc

SEQ ID NO: 550 - DNA, 20 bp, Artificial Sequence
  Oligomeric compound
tgctgactgctcgcccttgc

SEQ ID NO: 551 - DNA, 20 bp, Artificial Sequence
  Oligomeric compound
actcccagggtgtaactcta

SEQ ID NO: 552 - DNA, 20 bp, Artificial Sequence
  Oligomeric compound
catgaagaaagactgtagcc

SEQ ID NO: 553 - DNA, 20 bp, Artificial Sequence
  Oligomeric compound
gacaaggtgggagcgagtgg

SEQ ID NO: 554 - DNA, 20 bp, Artificial Sequence
  Oligomeric compound
tgctcagccagccccattct

SEQ ID NO: 555 - DNA, 20 bp, Artificial Sequence
  Oligomeric compound
gcttttagaaccactgcctc

SEQ ID NO: 556 - DNA, 20 bp, Artificial Sequence
  Oligomeric compound
ggagtagatgatggttagcc

SEQ ID NO: 557 - DNA, 20 bp, Artificial Sequence
  Oligomeric compound
actgattcaagagctttgta

SEQ ID NO: 558 - DNA, 20 bp, Artificial Sequence
  Oligomeric compound
gtagataactaaacactacc

SEQ ID NO: 559 - DNA, 20 bp, Artificial Sequence
  Oligomeric compound
aatccattgaagaggcgatt

SEQ ID NO: 560 - DNA, 20 bp, Artificial Sequence
  Oligomeric compound
ggtaagaggatgcgctgctc

SEQ ID NO: 561 - DNA, 20 bp, Artificial Sequence
  Oligomeric compound
ggcctaatatccctacccca

SEQ ID NO: 562 - DNA, 20 bp, Artificial Sequence
  Oligomeric compound
gtgttcagaaacccaggccc

SEQ ID NO: 563 - DNA, 20 bp, Artificial Sequence
  Oligomeric compound
tccaggatgcaaaagcacga

SEQ ID NO: 564 - DNA, 20 bp, Artificial Sequence
  Oligomeric compound
tacaacggcattgtcctgaa

SEQ ID NO: 565 - DNA, 20 bp, Artificial Sequence
  Oligomeric compound
tttcaggctcacctccccag

SEQ ID NO: 566 - DNA, 20 bp, Artificial Sequence
  Oligomeric compound
aaaaataatctctgcacagg

SEQ ID NO: 567 - DNA, 20 bp, Artificial Sequence
  Oligomeric compound
agaatgagttgacataccaa

SEQ ID NO: 568 - DNA, 20 bp, Artificial Sequence
  Oligomeric compound
gcttcacaattagaccatcc

SEQ ID NO: 569 - DNA, 20 bp, Artificial Sequence
  Oligomeric compound
agactccacaccactcatac

SEQ ID NO: 570 - DNA, 20 bp, Artificial Sequence
  Oligomeric compound
atccattggacagtcgattt

SEQ ID NO: 571 - DNA, 20 bp, Artificial Sequence
  Oligomeric compound
ggcgggcggctctgaggcgg

SEQ ID NO: 572 - DNA, 20 bp, Artificial Sequence
  Oligomeric compound
ctctttaggccagatcctca

SEQ ID NO: 573 - DNA, 20 bp, Artificial Sequence
  Oligomeric compound
taatggtatgtgtggtgata

SEQ ID NO: 574 - DNA, 20 bp, Artificial Sequence
  Oligomeric compound
attactaagttgttagctgt

SEQ ID NO: 575 - DNA, 20 bp, Artificial Sequence
  Oligomeric compound
gatgctaatctacttcacta

SEQ ID NO: 576 - DNA, 20 bp, Artificial Sequence
  Oligomeric compound
tcagcatggtgccctcgccc

SEQ ID NO: 577 - DNA, 20 bp, Artificial Sequence
  Oligomeric compound
tccgcgggggcggggaggct

SEQ ID NO: 578 - DNA, 20 bp, Artificial Sequence
  Oligomeric compound
agaccacagccactctaatc

SEQ ID NO: 579 - DNA, 20 bp, Artificial Sequence
  Oligomeric compound
tccgtttccatcgttccacc

SEQ ID NO: 580 - DNA, 20 bp, Artificial Sequence
  Oligomeric compound
gccagtgtacacaaaccaac

SEQ ID NO: 581 - DNA, 20 bp, Artificial Sequence
  Oligomeric compound
aaggctttttgctcaagggc

SEQ ID NO: 582 - DNA, 20 bp, Artificial Sequence
  Oligomeric compound
ttgacctgaatgctacaagg

SEQ ID NO: 583 - DNA, 20 bp, Artificial Sequence
  Oligomeric compound
tgccctgctcagagccctag

SEQ ID NO: 584 - DNA, 20 bp, Artificial Sequence
  Oligomeric compound
tcaatgtgatggcaccacca

SEQ ID NO: 585 - DNA, 20 bp, Artificial Sequence
  Oligomeric compound
acctcccagccaatccatgt

SEQ ID NO: 586 - DNA, 20 bp, Artificial Sequence
  Oligomeric compound
tcctggatgatatctacctc

SEQ ID NO: 587 - DNA, 20 bp, Artificial Sequence
  Oligomeric compound
tctcccttgatgtaattcta

SEQ ID NO: 588 - DNA, 20 bp, Artificial Sequence
  Oligomeric compound
agagcggagtgtttatgtca

SEQ ID NO: 589 - DNA, 20 bp, Artificial Sequence
  Oligomeric compound
tcattcatttgaaggaaata

SEQ ID NO: 590 - DNA, 20 bp, Artificial Sequence
  Oligomeric compound
tccaagatggggtatgaccc

SEQ ID NO: 591 - DNA, 20 bp, Artificial Sequence
  Oligomeric compound
tttttaaacacacattcgcg

SEQ ID NO: 592 - DNA, 20 bp, Artificial Sequence
  Oligomeric compound
agatgtgtttccattccact

SEQ ID NO: 593 - DNA, 20 bp, Artificial Sequence
  Oligomeric compound
ccccctgccgctggtactct

SEQ ID NO: 594 - DNA, 20 bp, Artificial Sequence
  Oligomeric compound
cggccggagccatagactcg

SEQ ID NO: 595 - DNA, 20 bp, Artificial Sequence
  Oligomeric compound
ctttcagagagccacagcct

SEQ ID NO: 596 - DNA, 20 bp, Artificial Sequence
  Oligomeric compound
gcttcccagcggcctatagt

SEQ ID NO: 597 - DNA, 20 bp, Artificial Sequence
  Oligomeric compound
cagcagaatatcacacagct

SEQ ID NO: 598 - DNA, 20 bp, Artificial Sequence
  Oligomeric compound
tacaatttgggagtcctgaa

SEQ ID NO: 599 - DNA, 20 bp, Artificial Sequence
  Oligomeric compound
gcctccttcatatattctca

SEQ ID NO: 600 - DNA, 20 bp, Artificial Sequence
  Oligomeric compound
ccccatcttagcatctaagg

SEQ ID NO: 601 - DNA, 20 bp, Artificial Sequence
  Oligomeric compound
ttgtatggacatttaaatca

SEQ ID NO: 602 - DNA, 20 bp, Artificial Sequence
  Oligomeric compound
tttgattttaattccaaact

SEQ ID NO: 603 - DNA, 20 bp, Artificial Sequence
  Oligomeric compound
caaacggtaagatttgcaga

SEQ ID NO: 604 - DNA, 20 bp, Artificial Sequence
  Oligomeric compound
ggatttaaacggtaaacatc

SEQ ID NO: 605 - DNA, 20 bp, Artificial Sequence
  Oligomeric compound
ctctagctccctcaccagtg

SEQ ID NO: 606 - DNA, 20 bp, Artificial Sequence
  Oligomeric compound
gcttgtccacacagttcaac

SEQ ID NO: 607 - DNA, 20 bp, Artificial Sequence
  Oligomeric compound
gcattgtatgttcatatggg

SEQ ID NO: 608 - DNA, 20 bp, Artificial Sequence
  Oligomeric compound
tgtcgtagtacatcagaaca

SEQ ID NO: 609 - DNA, 20 bp, Artificial Sequence
  Oligomeric compound
agccagtgtgtaaaatgaga

SEQ ID NO: 610 - DNA, 20 bp, Artificial Sequence
  Oligomeric compound
ttcagatatacagcatcggt

SEQ ID NO: 611 - DNA, 20 bp, Artificial Sequence
  Oligomeric compound
tgaccacaaaattccttaca

SEQ ID NO: 612 - DNA, 20 bp, Artificial Sequence
  Oligomeric compound
acaactacattcttcttgta

SEQ ID NO: 613 - DNA, 20 bp, Artificial Sequence
  Oligomeric compound
tgcaccttttcaaaatccac

SEQ ID NO: 614 - DNA, 20 bp, Artificial Sequence
  Oligomeric compound
aacgtaatccgtattatcca

SEQ ID NO: 615 - DNA, 20 bp, Artificial Sequence
  Oligomeric compound
cgtgagggctaggaaattgc

SEQ ID NO: 616 - DNA, 20 bp, Artificial Sequence
  Oligomeric compound
gcaacaggcctcaatatctt

SEQ ID NO: 617 - DNA, 20 bp, Artificial Sequence
  Oligomeric compound
acgaggggtcagagcagcgc

SEQ ID NO: 618 - DNA, 20 bp, Artificial Sequence
  Oligomeric compound
ggcagacgaaaggctgacag

SEQ ID NO: 619 - DNA, 20 bp, Artificial Sequence
  Oligomeric compound
ctgcaccatgttcggctccc

SEQ ID NO: 620 - DNA, 20 bp, Artificial Sequence
  Oligomeric compound
ggggccctcagggctggggc

SEQ ID NO: 621 - DNA, 20 bp, Artificial Sequence
  Oligomeric compound
ccggtccactctgtatccag

SEQ ID NO: 622 - DNA, 20 bp, Artificial Sequence
  Oligomeric compound
gctgggaaagagagggcaga

SEQ ID NO: 623 - DNA, 20 bp, Artificial Sequence
  Oligomeric compound
tcagattgccaacattgtga

SEQ ID NO: 624 - DNA, 20 bp, Artificial Sequence
  Oligomeric compound
ctggggagggggttagcgtc

SEQ ID NO: 625 - DNA, 20 bp, Artificial Sequence
  Oligomeric compound
tgggtctggggcagcgcagt

SEQ ID NO: 626 - DNA, 20 bp, Artificial Sequence
  Oligomeric compound
ttgaagtagcacagtcatac

SEQ ID NO: 627 - DNA, 20 bp, Artificial Sequence
  Oligomeric compound
tctaccacatggagtgtcca

SEQ ID NO: 628 - DNA, 20 bp, Artificial Sequence
  Oligomeric compound
agtgccgctgccgcgccgtg

SEQ ID NO: 629 - DNA, 20 bp, Artificial Sequence
  Oligomeric compound
acacattgagagcctcctga

SEQ ID NO: 630 - DNA, 20 bp, Artificial Sequence
  Oligomeric compound
gtcgctcagtgctctctagg

SEQ ID NO: 631 - DNA, 20 bp, Artificial Sequence
  Oligomeric compound
aggctcctctgatggaaggt

SEQ ID NO: 632 - DNA, 20 bp, Artificial Sequence
  Oligomeric compound
gctgtgacttctgatattat

SEQ ID NO: 633 - DNA, 20 bp, Artificial Sequence
  Oligomeric compound
gacatcatgtgatttgctca

SEQ ID NO: 634 - DNA, 20 bp, Artificial Sequence
  Oligomeric compound
caccccaaggctgcagggca

SEQ ID NO: 635 - DNA, 20 bp, Artificial Sequence
  Oligomeric compound
tgtcaagcctggtaccacca

SEQ ID NO: 636 - DNA, 20 bp, Artificial Sequence
  Oligomeric compound
ctgctccagagcccgagtcg

SEQ ID NO: 637 - DNA, 20 bp, Artificial Sequence
  Oligomeric compound
accctccgctggctgtcccc

SEQ ID NO: 638 - DNA, 20 bp, Artificial Sequence
  Oligomeric compound
tagagtgaatttatcttggt

SEQ ID NO: 639 - DNA, 20 bp, Artificial Sequence
  Oligomeric compound
tggtgactgattcttatcca

SEQ ID NO: 640 - DNA, 20 bp, Artificial Sequence
  Oligomeric compound
caatatgattggatagagga

SEQ ID NO: 641 - DNA, 20 bp, Artificial Sequence
  Oligomeric compound
tttaaacacacattcgcgcc

SEQ ID NO: 642 - DNA, 20 bp, Artificial Sequence
  Oligomeric compound
accgggtggtatcatagacc

SEQ ID NO: 643 - DNA, 20 bp, Artificial Sequence
  Oligomeric compound
tgcatacctgttcagttgga

SEQ ID NO: 644 - DNA, 20 bp, Artificial Sequence
  Oligomeric compound
gcccgcctctctcggccccc

SEQ ID NO: 645 - DNA, 20 bp, Artificial Sequence
  Oligomeric compound
tcgccccctcccaggcctct

SEQ ID NO: 646 - DNA, 20 bp, Artificial Sequence
  Oligomeric compound
acaactgtagagtatggtca

SEQ ID NO: 647 - DNA, 20 bp, Artificial Sequence
  Oligomeric compound
gctgaccatcagtactttcc

SEQ ID NO: 648 - DNA, 20 bp, Artificial Sequence
  Oligomeric compound
ttatagaacagcctccagtg

SEQ ID NO: 649 - DNA, 20 bp, Artificial Sequence
  Oligomeric compound
ttcaggcactagcagtgggt

SEQ ID NO: 650 - DNA, 20 bp, Artificial Sequence
  Oligomeric compound
agtactgcgaggttaaccgc

SEQ ID NO: 651 - DNA, 20 bp, Artificial Sequence
  Oligomeric compound
ggacctttaagatgcaaagt

SEQ ID NO: 652 - DNA, 20 bp, Artificial Sequence
  Oligomeric compound
ttcatattatccacccaggt

SEQ ID NO: 653 - DNA, 20 bp, Artificial Sequence
  Oligomeric compound
cggatcctgttacctcacca

SEQ ID NO: 654 - DNA, 20 bp, Artificial Sequence
  Oligomeric compound
tggtgcctgccacatctttg

SEQ ID NO: 655 - DNA, 20 bp, Artificial Sequence
  Oligomeric compound
tgggaggctgaatcaaggac

SEQ ID NO: 656 - DNA, 20 bp, Artificial Sequence
  Oligomeric compound
tgacaaccaggaagcttgtg

SEQ ID NO: 657 - DNA, 20 bp, Artificial Sequence
  Oligomeric compound
gccaggcagcgagcttttga

SEQ ID NO: 658 - DNA, 20 bp, Artificial Sequence
  Oligomeric compound
cagcctgccaccgccgcttt

SEQ ID NO: 659 - DNA, 20 bp, Artificial Sequence
  Oligomeric compound
ctgcccccgtggaccgaaca

SEQ ID NO: 660 - DNA, 20 bp, Artificial Sequence
  Oligomeric compound
tcgtgcacctgaggagtctg

SEQ ID NO: 661 - DNA, 20 bp, Artificial Sequence
  Oligomeric compound
caaacgtgctgtcttcctcc

SEQ ID NO: 662 - DNA, 20 bp, Artificial Sequence
  Oligomeric compound
aaggactcagcagtgtttca

SEQ ID NO: 663 - DNA, 20 bp, Artificial Sequence
  Oligomeric compound
tcctcggtggcagagctcag

SEQ ID NO: 664 - DNA, 20 bp, Artificial Sequence
  Oligomeric compound
agacaatgagtacacagttc

SEQ ID NO: 665 - DNA, 20 bp, Artificial Sequence
  Oligomeric compound
ctgcaagcactggttcccat

SEQ ID NO: 666 - DNA, 20 bp, Artificial Sequence
  Oligomeric compound
ttgcctgagctgcccaaact

SEQ ID NO: 667 - DNA, 20 bp, Artificial Sequence
  Oligomeric compound
tccatcacactgtcctatga

SEQ ID NO: 668 - DNA, 20 bp, Artificial Sequence
  Oligomeric compound
gagggattgtatgaacatct

SEQ ID NO: 669 - DNA, 20 bp, Artificial Sequence
  Oligomeric compound
gcttgtgcggactaatacca

SEQ ID NO: 670 - DNA, 20 bp, Artificial Sequence
  Oligomeric compound
gcaggctaaaagaaataagc

SEQ ID NO: 671 - DNA, 20 bp, Artificial Sequence
  Oligomeric compound
attgtatagacattaaatca

SEQ ID NO: 672 - DNA, 20 bp, Artificial Sequence
  Oligomeric compound
gttgagcgcagtaagacaac

SEQ ID NO: 673 - DNA, 20 bp, Artificial Sequence
  Oligomeric compound
agatgtttctggcctgcgag

SEQ ID NO: 674 - DNA, 20 bp, Artificial Sequence
  Oligomeric compound
gacaaactcagctatattgt

SEQ ID NO: 675 - DNA, 20 bp, Artificial Sequence
  Oligomeric compound
acggctctgtggcactcata

SEQ ID NO: 676 - DNA, 20 bp, Artificial Sequence
  Oligomeric compound
gctttcttactttccacagc

SEQ ID NO: 677 - DNA, 20 bp, Artificial Sequence
  Oligomeric compound
tacctttagaatagacagca

SEQ ID NO: 678 - DNA, 20 bp, Artificial Sequence
  Oligomeric compound
aggctggacagcacacaacc

SEQ ID NO: 679 - DNA, 20 bp, Artificial Sequence
  Oligomeric compound
agcaggagccttatctctcc

SEQ ID NO: 680 - DNA, 20 bp, Artificial Sequence
  Oligomeric compound
atgagtgagcagtagaatca

SEQ ID NO: 681 - DNA, 20 bp, Artificial Sequence
  Oligomeric compound
tgagactttattactatcac

SEQ ID NO: 682 - DNA, 20 bp, Artificial Sequence
  Oligomeric compound
tactttactccaaggtttta

SEQ ID NO: 683 - DNA, 20 bp, Artificial Sequence
  Oligomeric compound
gcacccgcctcacacacgtg

SEQ ID NO: 684 - DNA, 20 bp, Artificial Sequence
  Oligomeric compound
ttcccgacctgcctttacct

SEQ ID NO: 685 - DNA, 20 bp, Artificial Sequence
  Oligomeric compound
tcctgtaattataggctagc

SEQ ID NO: 686 - DNA, 20 bp, Artificial Sequence
  Oligomeric compound
ggatcatatcaataatacca

SEQ ID NO: 687 - DNA, 20 bp, Artificial Sequence
  Oligomeric compound
tgctgagacacacaatatgt

SEQ ID NO: 688 - DNA, 20 bp, Artificial Sequence
  Oligomeric compound
tgtttgtctccaagaaacgt

SEQ ID NO: 689 - DNA, 20 bp, Artificial Sequence
  Oligomeric compound
tgtcatggacaggatgaata

SEQ ID NO: 690 - DNA, 20 bp, Artificial Sequence
  Oligomeric compound
tctatcatactcagagtcgg

SEQ ID NO: 691 - DNA, 20 bp, Artificial Sequence
  Oligomeric compound
ttgtgacaggaagcaaatcc

SEQ ID NO: 692 - DNA, 20 bp, Artificial Sequence
  Oligomeric compound
catcagagtcaccaacccca

SEQ ID NO: 693 - DNA, 20 bp, Artificial Sequence
  Oligomeric compound
caagagatgtctcgttttgc

SEQ ID NO: 694 - DNA, 21 bp, Artificial Sequence
  Oligomeric compound
gtggtagaacagcatgacgtc

SEQ ID NO: 695 - DNA, 21 bp, Artificial Sequence
  Oligomeric compound
agctgtgaagccacgatgggc

SEQ ID NO: 696 - DNA, 21 bp, Artificial Sequence
  Oligomeric compound
agatacaaagatggaaaaatc

SEQ ID NO: 697 - DNA, 21 bp, Artificial Sequence
  Oligomeric compound
cttccttactattgctcacaa

SEQ ID NO: 698 - DNA, 21 bp, Artificial Sequence
  Oligomeric compound
tgtttaatatatatttcactc

SEQ ID NO: 699 - DNA, 21 bp, Artificial Sequence
  Oligomeric compound
tgtcaagacatcgcgttaaca

SEQ ID NO: 700 - DNA, 21 bp, Artificial Sequence
  Oligomeric compound
tgtcgatttagttatccaaca

SEQ ID NO: 701 - DNA, 21 bp, Artificial Sequence
  Oligomeric compound
gtgactatacggataccacac

SEQ ID NO: 702 - DNA, 19 bp, Artificial Sequence
  Oligomeric compound
acctctccaaatgtaaaga

SEQ ID NO: 703 - DNA, 21 bp, Artificial Sequence
  Oligomeric compound
caaagcggaaaccaatcactg

SEQ ID NO: 704 - DNA, 21 bp, Artificial Sequence
  Oligomeric compound
ctgcagtacatgcacatatca

SEQ ID NO: 705 - DNA, 20 bp, Artificial Sequence
  Oligomeric compound
aacaatgacacccttgacct

SEQ ID NO: 706 - DNA, 20 bp, Artificial Sequence
  Oligomeric compound
ttttaatcttaagtcacaaa

SEQ ID NO: 707 - DNA, 21 bp, Artificial Sequence
  Oligomeric compound
atctccacagcgggcaatgtc

SEQ ID NO: 708 - DNA, 21 bp, Artificial Sequence
  Oligomeric compound
tatgaagaccaatacactcca

SEQ ID NO: 709 - DNA, 18 bp, Artificial Sequence
  Oligomeric compound
ggggcaacatcactgccc

SEQ ID NO: 710 - DNA, 21 bp, Artificial Sequence
  Oligomeric compound
ccatgttagcaggtccatatg

SEQ ID NO: 711 - DNA, 21 bp, Artificial Sequence
  Oligomeric compound
gtttgatagtttagacacaaa

SEQ ID NO: 712 - DNA, 20 bp, Artificial Sequence
  Oligomeric compound
tgggtcaggactaaagcttc

SEQ ID NO: 713 - DNA, 21 bp, Artificial Sequence
  Oligomeric compound
aataccatacagaaacacagc

SEQ ID NO: 714 - DNA, 20 bp, Artificial Sequence
  Oligomeric compound
ttcgtgatgattgtcgtgcc

SEQ ID NO: 715 - DNA, 21 bp, Artificial Sequence
  Oligomeric compound
actgcgagactgttcacagtt

SEQ ID NO: 716 - DNA, 21 bp, Artificial Sequence
  Oligomeric compound
tacaggtgagcggatgttctg

SEQ ID NO: 717 - DNA, 21 bp, Artificial Sequence
  Oligomeric compound
tctcagctcccaactgaccag

SEQ ID NO: 718 - DNA, 21 bp, Artificial Sequence
  Oligomeric compound
accgcagatattacagccact

SEQ ID NO: 719 - DNA, 21 bp, Artificial Sequence
  Oligomeric compound
cctgatagcccttcttaagga

SEQ ID NO: 720 - DNA, 21 bp, Artificial Sequence
  Oligomeric compound
cttgatccatatgcaacaagg

SEQ ID NO: 721 - DNA, 20 bp, Artificial Sequence
  Oligomeric compound
gccattgggacctgcacacc

SEQ ID NO: 722 - DNA, 20 bp, Artificial Sequence
  Oligomeric compound
gcatgggtaccaccccatgc

SEQ ID NO: 723 - DNA, 21 bp, Artificial Sequence
  Oligomeric compound
cgagttcaaaactcaatccca

SEQ ID NO: 724 - DNA, 21 bp, Artificial Sequence
  Oligomeric compound
cttgaactccatgccacaagg

SEQ ID NO: 725 - DNA, 20 bp, Artificial Sequence
  Oligomeric compound
gtagatctcaaaaagctagc

SEQ ID NO: 726 - DNA, 20 bp, Artificial Sequence
  Oligomeric compound
gaacagggtaaaatcactac

SEQ ID NO: 727 - DNA, 20 bp, Artificial Sequence
  Oligomeric compound
agacaaaaacagactctgaa

SEQ ID NO: 728 - DNA, 21 bp, Artificial Sequence
  Oligomeric compound
gctagtgacaggtccagacag

SEQ ID NO: 729 - DNA, 21 bp, Artificial Sequence
  Oligomeric compound
tttactcatacctcgcaacca

SEQ ID NO: 730 - DNA, 22 bp, Artificial Sequence
  Oligomeric compound
ttaattgtatgacattaaatca

SEQ ID NO: 731 - DNA, 21 bp, Artificial Sequence
  Oligomeric compound
tgccatgagattcaacagtca

SEQ ID NO: 732 - DNA, 21 bp, Artificial Sequence
  Oligomeric compound
gataatatttagaatcttaac

SEQ ID NO: 733 - DNA, 21 bp, Artificial Sequence
  Oligomeric compound
tagtgtctcatcgcaaactta

SEQ ID NO: 734 - DNA, 21 bp, Artificial Sequence
  Oligomeric compound
ctgttgcctaacgaacacaga

SEQ ID NO: 735 - DNA, 22 bp, Artificial Sequence
  Oligomeric compound
tgctgattacgaaagacaggat

SEQ ID NO: 736 - DNA, 21 bp, Artificial Sequence
  Oligomeric compound
gcttagctgtgtcttacagct

SEQ ID NO: 737 - DNA, 20 bp, Artificial Sequence
  Oligomeric compound
  misc_feature 1-20: n = A,T,C or G
nnnnnnnnnnnnnnnnnnnn

SEQ ID NO: 738 - DNA, 20 bp, Artificial Sequence
  Oligomeric compound
ttgtcccagtcccaggcctc

SEQ ID NO: 739 - DNA, 20 bp, Artificial Sequence
  Oligomeric compound
gccctccatgctggcacagg

SEQ ID NO: 740 - DNA, 20 bp, Artificial Sequence
  Oligomeric compound
gcttcacagcttccagtcga

SEQ ID NO: 741 - DNA, 20 bp, Artificial Sequence
  Oligomeric compound
cccatctgtggcttcacagc

SEQ ID NO: 742 - DNA, 20 bp, Artificial Sequence
  Oligomeric compound
tgaaagcccatctgtggctt

SEQ ID NO: 743 - DNA, 20 bp, Artificial Sequence
  Oligomeric compound
gcagctgcaaacatccgact

SEQ ID NO: 744 - DNA, 20 bp, Artificial Sequence
  Oligomeric compound
catctgtggcttcacagctt

SEQ ID NO: 745 - DNA, 20 bp, Artificial Sequence
  Oligomeric compound
aagcccatctgtggcttcac

SEQ ID NO: 746 - DNA, 19 bp, Artificial Sequence
  PCR primer
ggtggtggaatgcgtcatg

SEQ ID NO: 747 - DNA, 20 bp, Artificial Sequence
  PCR primer
caacgtcccttggcttatgc

SEQ ID NO: 748 - DNA, 30 bp, Artificial Sequence
  PCR probe
aaggcgtcacttccacgagagtttatgaga

SEQ ID NO: 749 - DNA, 17 bp, Artificial Sequence
  PCR primer
ggcctccgcaggttctg

SEQ ID NO: 750 - DNA, 21 bp, Artificial Sequence
  PCR primer
ttcggagcctatctgttggaa

SEQ ID NO: 751 - DNA, 24 bp, Artificial Sequence
  PCR probe
tccaggccggagtcagagactcca

SEQ ID NO: 752 - DNA, 19 bp, Artificial Sequence
  PCR primer
acctgcgcacaatgacaca

SEQ ID NO: 753 - DNA, 21 bp, Artificial Sequence
  PCR primer
tggctcgagaagaaggctatg

SEQ ID NO: 754 - DNA, 21 bp, Artificial Sequence
  PCR probe
cctccgccagagtcaccagcg

SEQ ID NO: 755 - DNA, 27 bp, Artificial Sequence
  PCR primer
aaatatcagtgtgaattacagcaaacc

SEQ ID NO: 756 - DNA, 20 bp, Artificial Sequence
  PCR primer
ggaatcgctttctgggtcaa

SEQ ID NO: 757 - DNA, 31 bp, Artificial Sequence
  PCR probe
tgctgttatgggtgaaactctgggagattct

SEQ ID NO: 758 - DNA, 22 bp, Artificial Sequence
  Oligomeric compound
agactagcggtatctttatccc

SEQ ID NO: 759 - DNA, 20 bp, Artificial Sequence
  Oligomeric compound
agcaaaagatcaatccgtta

SEQ ID NO: 760 - DNA, 22 bp, Artificial Sequence
  Oligomeric compound
ccacacacttccttacattcca

SEQ ID NO: 761 - DNA, 20 bp, Artificial Sequence
  Oligomeric compound
atctgcactgtcagcacttt

SEQ ID NO: 762 - DNA, 22 bp, Artificial Sequence
  Oligomeric compound
acccttatcagttctccgtcca

SEQ ID NO: 763 - DNA, 21 bp, Artificial Sequence
  Oligomeric compound
gccaatatttctgtgctgcta

SEQ ID NO: 764 - DNA, 21 bp, Artificial Sequence
  Oligomeric compound
ctgggactttgtaggccagtt

SEQ ID NO: 765 - DNA, 24 bp, Artificial Sequence
  PCR primer
gaggtagtaggttgtgtggtttca

SEQ ID NO: 766 - DNA, 25 bp, Artificial Sequence
  PCR primer
agggaaggcagtaggttgtatagtt

SEQ ID NO: 767 - DNA, 23 bp, Artificial Sequence
  PCR probe
cagtgatgttgcccctcggaaga

SEQ ID NO: 768 - DNA, 18 bp, Artificial Sequence
  PCR primer
tgcatccgggttgaggta

SEQ ID NO: 769 - DNA, 27 bp, Artificial Sequence
  PCR primer
aggaaagctagaaggttgtacagttaa

SEQ ID NO: 770 - DNA, 31 bp, Artificial Sequence
  PCR probe
aggttgtatggtttagagttacaccctggga

SEQ ID NO: 771 - DNA, 24 bp, Artificial Sequence
  PCR primer
cctaggaagaggtagtaggttgca

SEQ ID NO: 772 - DNA, 25 bp, Artificial Sequence
  PCR primer
cagcaggtcgtatagttacctcctt

SEQ ID NO: 773 - DNA, 25 bp, Artificial Sequence
  PCR probe
agttttagggcagggattttgccca

SEQ ID NO: 774 - DNA, 23 bp, Artificial Sequence
  PCR primer
ttccaggctgaggtagtagtttg

SEQ ID NO: 775 - DNA, 21 bp, Artificial Sequence
  PCR primer
ttatctcctgtaccgggtggt

SEQ ID NO: 776 - DNA, 17 bp, Artificial Sequence
  PCR probe
acagtttgagggtctat

SEQ ID NO: 777 - DNA, 25 bp, Artificial Sequence
  PCR primer
tgaggtagtagtttgtgctgttggt

SEQ ID NO: 778 - DNA, 21 bp, Artificial Sequence
  PCR primer
aggcagtagcttgcgcagtta

SEQ ID NO: 779 - DNA, 23 bp, Artificial Sequence
  PCR probe
ttgtgacattgcccgctgtggag

SEQ ID NO: 780 - DNA, 30 bp, Artificial Sequence
  PCR primer
ggatgaggtagtaggttgtatagttttagg

SEQ ID NO: 781 - DNA, 32 bp, Artificial Sequence
  PCR primer
cgttaggaaagacagtagattgtatagttatc

SEQ ID NO: 782 - DNA, 16 bp, Artificial Sequence
  PCR probe
tcacacccaccactgg

SEQ ID NO: 783 - DNA, 28 bp, Artificial Sequence
  PCR primer
gggtgaggtagtaggttgtatagtttgg

SEQ ID NO: 784 - DNA, 31 bp, Artificial Sequence
  PCR primer
cacttcaggaaagacagtagattgtatagtt

SEQ ID NO: 785 - DNA, 16 bp, Artificial Sequence
  PCR probe
ctctgccctgctatgg

SEQ ID NO: 786 - DNA, 17 bp, Artificial Sequence
  PCR primer
tcccagcctgaggtgca

SEQ ID NO: 787 - DNA, 23 bp, Artificial Sequence
  PCR primer
gcttcatctcagactcccaactg

SEQ ID NO: 788 - DNA, 13 bp, Artificial Sequence
  PCR probe
tgctgcatctctg

SEQ ID NO: 789 - DNA, 22 bp, Artificial Sequence
  Oligomeric compound
ataccgcgatcagtgcatcttt

SEQ ID NO: 790 - DNA, 22 bp, Artificial Sequence
  Oligomeric compound
ccttccctgaaggttcctcctt

SEQ ID NO: 791 - DNA, 829 bp, H. sapiens
agttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttcacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcaccagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacgaatttatgaattgaattatcttggttgaaaataaaaagatcactttctcagttttcataagtattatgtctcttctgagctatttcatctatttttggcagtctgaatttttaaaacccatttatatttctttccttacctttttatttgcatgtggatcaaccatcgctttatt

SEQ ID NO: 792 - DNA, 8096 bp, H. sapiens
cttttctcaagacaactacataagcagacaaaattgcaaagatctgccctgtgtcgagtatgacagccacgactcgtggctctccggtcggagggaatgacaaccagggccaggctcctgatggacagtctctgccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatccttttgattgttttaaggccagtcggacaaatgcgagtaaaaagcaacgtgaaaagctacttgagctgatacgtcgtcttgcagaagatgataaagatggtgtgatggcacacagagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgtaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttttcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacctttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatccctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttctgttacacccactgcactcttaaccagtgttgctgcctcatggcagtggatcagctcc

SEQ ID NO: 793 - DNA, 3198 bp, H. sapiens
ctgccactgccacctcgcggatcaggagccagcgttgttcgcccgacgcctcgctgccggtgggaggaagcgagagggaagccgcttgggctcttgtcgccgctgctcgcccaccgcctggaagagccgagccccggccagtcggtcgcttgccaccgctcgtagccgttacccgcgggccgccacagccgccggcgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagatcaaagagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggaaaaaaaaaaaaa

SEQ ID NO: 794 - DNA, 1154 bp, H. sapiens
gcagccaaagccccaggagccctaggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcaccagcctcccaggagtggccaggtatggtgtgaagcggctggaagagatgctgaggcccttggtggaagagggcctacgctgtgtcttgatctttggcgtccccagcagagttcccaaggacgagcggggttccgcagctgactccgaggagtccccagctattgaggcaatccatctgttgaggaagaccttccccaacctcctggtggcctgtgatgtctgcctgtgtccctacacctcccatggtcactgcgggctcctgagtgaaaacggagcattccgggctgaggagagccgccagcggctggctgaggtggcattggcgtatgccaaggcaggatgtcaggtggtagccccgtcggacatgatggatggacgcgtggaagccatcaaagaggccctgatggcacatggacttggcaacagggtatcggtgatgagctacagtgccaaatttgcttcctgtttctatggccctttccgggatgcagctaagtcaagcccagcttttggggaccgccgctgctaccagctgccccctggagcacgaggcctggctctccgagctgtggaccgggatgtacgggaaggagctgacatgctcatggtgaagccgggaatgccctacctggacatcgtgcgggaggtaaaggacaagcaccctgacctccctctcgccgtgtaccacgtctctggagagtttgccatgctgtggcatggagcccaggccggggcatttgatctcaaggctgccgtactggaggccatgactgccttccgcagagcaggtgctgacatcatcatcacctactacacaccgcagctgctgcagtggctgaaggaggaatgatggaggacagtgccaggcccaagaactagaactttcaaacgttcccggggcctcagacaagtgacaaccaaagtaaatgctgcttttagaactgt

SEQ ID NO: 795 - DNA, 3582 bp, H. sapiens
gcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattggaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaaacaagaaatcctcccgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaccagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttccatccaagtgtgtggatccgtgaatgttccgtatgttccttcccacttccagtgaaattctggatgggaaccagctcccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatgggccaaattttaaaatgttatttttcatatcatttataatcttgtcacaatccacttaaagaagtttggttatatttcagtgaaaattttcttccagagtaggttttttttcgtgggttgggggggtaactttactacaattaggtaagtatggtgcagaatttcatgcaaatgaggagtgccagcagtgtgataatttaaacatatttaaacaaaaacaaaaaaatgaatgcacaaacttgctgctgcttagatcactgcagcttctaggacccggtttcttttactgatttaaaaaaaaaa

SEQ ID NO: 796 - DNA, 3926 bp, H. sapiens
gataacctgccccttacgcctgtcattcagcctggcaggtccttagtgggctagacctacctttctgatgagctgcccgcccccagcgcaagatgattgtttgagaggtaaaaactcttgccaaaaacaacgttaaacttttaatggatgttaacatacttgcatttacaagcagtgaagtttgtcaccttcatgttgttatttatgcagcattaacctttttctccagatcattgagactgaaaatatgatggaccgaattgtgactggcttgtctgagtctagtgtcaaggtgcggttagctgccgtcaggtatgagctttaaatggtctgaataaaaaccttttgccatatatttaacctgttgcctttctggtccttcactgagtaaacacagactacaaatgttcctcaaaaatctgctcaggtgaattcatagagtatataacattgtctaacagagagcctggcctccaaaccccataaagtggtctgatgtagttcacttaacaatgtagatatgcttgaagtgtacattagtcattgtaaaatgccagccagtttgtttgaaaagtaaaagttttgatttcttgtgaagctaattttgattattctttgtagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcattttttttttctttaagcactttattcagaacaatacatgttcttctggtagtgtttggataatatgattttaacacatgctaataaaagccaagaaaaatcaaaaaaaaaaaaaaaaaaa

SEQ ID NO: 797 - DNA, 3320 bp, H. sapiens
gtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctgcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctccactcacacatgtagacaaacattagctctttactctttctcaaccccttatatgattttaataattctcacttcactaattttgtaagcctgagatcaataagaaatgttcaggagagaggaaagaaaaaatatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaa

SEQ ID NO: 798 - DNA, 1549 bp, H. sapiens
ggaaggattacactgttccagtttttagggagaaaggtttaccaaaccgatggccttaaatgattttcgctccttgatattatcatcttgaaggaaagctgcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacaaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaacaaaaaacaaaaacaaaagatttttatcaaatgttatgatgcaaaaaaaaaaaaaaaaaaaaaaaaa

SEQ ID NO: 799 - DNA, 2037 bp, H. sapiens
catcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggccattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcaaaaaaaaaaaaaaaaaaaaaaaaaaaaaagaaaaaaaaaaaaaaaaaaa

SEQ ID NO: 800 - DNA, 6799 bp, H. sapiens
ataagaataaaaattaccccaaatttccaaatcaagaagtaatcatggttcaggtttgggcagatgttctttctaggcatgaacacacgttatctcattgtttacttaacaccgggttataaacatttacccatagcatttgaaaggtagctatagatagaaaagaatcagagaagttctaaaacagctcttgcgctttgtttcaaattctctgcaggaaagatgaggtcttcagccttttttttagctggacggcaccgttgcagcagtggtgaacagggcactggattgagtcaggaaacccagctgtgaccttgggcaagccacttgccctctttgagcttcactcctgctaaggcaaggggcgctattcgtaccctgtctgcccacctcacaggctctggtgaagtccttgatttgaacgcctttagctcccaaggttgtggtttggagatagggcaggtcacatgaccatgaagactgaaggagaaacgtggaagcacgtgtgcctgttgcttcttttccaacttaaaatgcttggtgatctcctgaagactccagcctcctctctgggaagccaggatccacagaccctttacctgcgggtcatgggcagtcccagatggtccccctccccaacagagggggtgcagtgagacctccggaagttactgcctctgttaccctcaaagggattttcagatcagacagcccccctactccaagggacgtgtgtggagcttggtacctttatttatctcctgctccaacccctgtggactgcctgcacccagaatggggcctgtcctgctggcaagtggctgagaacctccactccactcagcagggctgttccccatttaccgaaaagctccgagagaaaataactaaccccatggcgccgctgtagctactggcagagcctcctggtccccacctctagcgcctgtggtttttgtttcatgcagagtgagcagtgaatctgggatcccatcagcagtcagtttgggtgcctgcgaggcacaatgatagatgttggtgaagggtatgtgtgaggatattaattaatattaacatgctagttatattaatattctcattggaatttgtggggctttgcaagttatatttcaaatatatggttttatgtaatccttttaactgccctgaaaccttgaaattattgcacctattttatagatggagagactgaggctcagaggggtgaattgcctaagatcctgggggaggaagcacccaggttttctggttttgagtcctgggcccttcctgctgagtagctacccccaacacagacctgcccttggagagcttgcagccacactgggaaggccagtgtattggattgctgcttagacctggaaagcacgtgaataaagcttcaggttaaaaccatgggggttccaggaggcagcagtcggctctgcctgggggtgagctgaggagccggtgctctctggaacaagggtagttgggctgaggctcagtggacagtggaggttggcaggtgaagtgcaggaggtctttgcagggagtgggaccaccttgagcacacacagaggaatgagacaggcaggttactcaaggagcagaggtctcgtgaccacttcccagagcatgtggggtcctagcctcatctccaggaggagaaagtgcatctatacacagatttgtcaatggagtttaaataggatgtgggaaaatctagattttccaaaacagtacatatttgctttgagaagaaaggtagatgcaggatgcataggttagataattttaatagcagtaacctcagagcatgtaagtatgatttgatttactggagtgcctggccgtctcagtcagtgggagcacggcttgggctgggagatgaggttgacaagggttctttctctcaaatgcttcctttggtttgctaagaggtatctcctactcggccgggggcagaagacttttccttcttttcccagtttgcagtagttgggccagatttgtggaagtgggagaaaggcctgccctgcttctacatagagttggctgtcctgacttgatactcggtgtgccttccagagacccgcctccatctcctcaactccctggcttgatgcttaggtggtgatggctgttgggcacaggagttacataacagatctgtgatggacccaggagcagagccagttgagtgaatgtcatggagtgggagtggtcttgcatggctgtggtgtcccctgcagcttgtgcagggtatgtggcaagaggtgctcaccactcatctggaatggctagactggaagcacttggccctcttgggctctgcacccccaccccctcccacctggcctgcctgctcatcttcatgggcgcctggggagaccaattatggctgcttgtcatagtggctcaggtcaccgttcacacttcctgggaccaggacatcagagccctgagaagggtcaaggggccaagtgggcctagccttttactgacagctgggaaatgcaagcgtgtggaccagagcaccaagtgagttggggccggtgtgggttcagcaccgtgtccctacccagagctccatttgttgaaaacagcctttctctaccgtttcttcacttggacaactttaaactatgtattggctggtcgcggtggctcacgcctgtaatcccagcactttgggaggccgaggtgggcaggtaacttgaggtcaggaggtcgagaccagcctggccaacatggtgaaacctcatctctactaaaaatacaaaaattagcccagcgtggtgacacgcacctgtaatcccagctactcgggaggctgaggcagaagaatcgcttgaacttgggaggcaaagattgcagtgagctgagattgcatcaccgcacttcagcctgggagacagagcgagactgcatctcaaaaaacaaacagaaacctacatattttctatatttcccccaacattgaggctcatttcttggatgaacaatttaaatgtactgtgcctctctggcaatattttccaaaattacagatgtttctatactttcaccggcagctctgcctcccagaatttattctacggatgggttaacacgtgtgcaaaatgatttatttgcaaggttcgtcattgttgccttatttttaatagcaaaagattggaggcagcttaaatgttcattcgcaggggccaatgaacaaaccatggcccgtctaaacatgggataccgcgtggccataatacataagatggacgctcaacgcactgtgccggattgagcagcaaggtggattgccgagggaagaagcaggtctgggcggtgtgtctcggagctgccatcagtgtaaaagggaagagaatcaaaagtgtcttgcttgtctatgcccagggggtctctgggcagacaccgcaagtcggtgattgtgatgcctctggagggggtgctggtcatgggagattgcttgtttgctggagatcccatgtaccttttgattgctgaagcaggtgaatgtacgcctttccaagaaattaaaatgggccaggtgcggtggctcacgcctgtaatcccagcagtttgggaggctgatgttggaggatcacttgaggtgaggggttcgagaccggcctggccaacatgatgaaaccccatctccactaaaaatacacaaattagccagacatggtggtacatgcctgtaatcccagctgctctagaggctgaggcaggagaatcatgtgaaccctagaggctgagtttacagtgagccaagatcatgccattgtactccagcctgagctacagagcgagactctgtctcaaataataaaataaaataaattaaaaacataaggactgtaaccttgcctcctgcccagtgtaggaaggtcaaggttctggctacttctcaagtacaggagcctcactcaggccccagaccactaatcaaaaaatatgtgcttggttctcacaaaggggccgagtgtgagggcttgggtgttgcttggtaaatacgacccccggtcccggccttggagagatggagccctctctgggccccttggacacactgctgttggctgactttgtcattttcaacccttgctccgattggctcacgtcatgatttctgaaacctttgggggcttccccactgacagaaagatacactttaactcagcactgggcatcccaggccctctttactgggcctcttcttgagccgcacttggcctgtcaccccttcctctgtctgccctcttaactccccacctccgtgcctttgctcatatagttccctttgcctgcctttccgtccagagcagtctccacgtgcccaggtcctgtctgactttcaagggccagcttagtttccacttctgcactgccttctgacctccctggcttctgtgtaaactgcccagatcaagccacacaatggttcctgcacccaaggaagctccctggggccccctcctggccactcgctcttcgccggtagtcaccactcacaccttggcactttcgcgtggtgcctgccgctgcctgtttgggcctcccacacacagagtgtacagaacggactcctcggtgtctggctgccttcccgcagcactgtcagatcatccaggttgcctgtagtggccctttggtttttttctctgctgcgtaggagttcaccaaatataccactatttattcattctcctgtggacaggcattgggttatgtccagcctcttcggtgaattcattcttgtctttgggggcgcgtgtgcgctctttgctgggtatacacccagggtgggttgatggcttacctgactcagaatgtgtttgcatgaatgaaattcaggttggtatgagaaatctagggtgtcctggctggagccaggcttcttgattacagggacagagcaggtacagggatcctggtttagacagcctgctcccatggggtggtagcattgttggggtgcaggatgctgaatctgcaggggacctatccgctcagtgcccagtgggattttagctggctggaaaggtggtcacatgtagaggggctcaacaatccagctaaagaggctgagcgttggtccattgttctcaatttgagagaaaactgagatcatcaaaattaggactggtatgtactaaaggaaagaacctaattacaaggctgaattgagtaagccctcgctgagggactttggatttctttgttgttcccctttatttctgcacccccacccaagtgacagatatgtacatgattggatgattttgctttcctggttgagagattcctgggaacttggcccaggagaagggggagaaatgtggagccgctagagtggcctccgcttgtttgtgttgattgaaggggagacggaaggagagctgtggacccctgaccccttgtgagggcatgtgatccttttcaaaaggctcaccaggcagaagtgcctggccaggggccgctctttccctctaatcccctctggagaagggccaggctgtgggttgctgacctgctctgatgtggatcagcctcccccaataatgcagctgcccagaagctcagagagcccaggcaacccccaaaggcaggagggccggctgtcattcccgttgtcattcccaggcggctggagtgggagcagagcggtcagttcagatgaacagtgctcgagtctgaccccaaccagcgagttatggtaagatggaaggttctccatctatattaaataagagaacaaaagccctcccaggctgcatgaatattccagggatatatatgtgaacgggttgccagtttagcttggcctgtgggtggcagccgcctgagtgagcacttcgtggctgcagctctaaagggtttggatctgaaactaatgaatgaaaatatgacctcagaagatttaaagagagcaaatacccagcaacagaacctgggtcccagagactgttgggagcatgaaatcccaggctggccgaaggaggaagtgggagagcaatggcagctgacatcacatggtgccagaccttctcagtgctttctgtgttcactcattattccgtccctctctctcagaggcaggtatggctgcttccccattttatagatgaggaagctaaggcaaggagaggttgtgtaacttgctcacagacacaaagctagccagtggcaaagctggaggtcaggtctaggtggtcaggctccagagttctgcggatttcacagcacggcagtggcagtcggaagaaccatttgtcaggtgattgtgggcaaatgacgtcagcccttcaaacctctgttttgcatctgcaagctgcttgctgctgcaacaaattaccagaaacttagtgacttaaaacacaaattaggtcgggtgcggtggctcacatctgtaatcccagcactttgggaggctgaggtgagtggatcacttgaggtcaggagttcgagaccagcctggccaacatgatgaaaccctgtctctaccaaaaatataaaaaattagccaggcatttggccgggtgtggtggatcacgcctgtaatcccagaactttgggaggacaaggtgggcggaacacaaggtcaggagttcaagaccagcctgaccaatatggtgaaagcctgtctctactaagaatacaaaattagcaggacgtggtggcacgcgcctgtagtcccagttactgggaggcggaggttgcagtgagccaagatcacgccactgcactccagcctgggtgacagagtgagactccgtctcac

SEQ ID NO: 801 - DNA, 4339 bp, H. sapiens
tgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 802 - DNA, 5161 bp, H. sapiens
ccagcgcctcacgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgacccgctgccctcgtccgtatcctttgtcacaggctatggtggcttcccggcctacagtttcgggcctggtgccaatgttggccgcccagccaggactctcatcccatccaccttcttcagggacttcgccatcaggctcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaagctcctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccagattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaatttttatatttttacacaatcatattttagtatggtgtctgtttatgtaactctgacttgctggaaaagttgaaactccaaataatctgaaactagaaaagaaatagcacataattactaccttccccttggcggctctcctcccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggggtgctttcttcattt

SEQ ID NO: 803 - DNA, 3775 bp, H. sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 804 - DNA, 5246 bp, H. sapiens
ggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaagagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacaacaacacagttacatagtaaaaggaggcctaaaatatgtgggcctcgctatggtgaaaccaaagaaaaagatattgactggggaaaactctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctgtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaaatggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaa

SEQ ID NO: 805 - DNA, 2158 bp, H. sapiens
ccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaaaaaaaaaaaaaaa

SEQ ID NO: 806 - DNA, 2428 bp, H. sapiens
cgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaac

SEQ ID NO: 807 - DNA, 643 bp, H. sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgctgtgcccttggggtggaaggggcaggattctgcagctgcttttgcatttctcttcctaaatttcattgtgttgatttctttccttcccaataggtgatcttaattactttcagaatattttcaaaatagatatatttttaaaatccttac

SEQ ID NO: 808 - DNA, 1669 bp, H. sapiens
ggggcgagacctacgacgccggcgagcagtggccgttacgcctaaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggtgcagcttttatttatgttttccctttggctgtgactgggtggggcagcatgcagcttctgattttaaagaggcatctagggaattgtcaggcaccctacaggaaggcctgccatgcttgtggccaactgtttcactggagcaaagaaagagatctcataggacggagggggaaaatggttttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttcctcaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttg

SEQ ID NO: 809 - DNA, 2126 bp, H. sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctctcctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaataaaaaaaaaaaaaaaaaaaaaaaaaaaaaaaaaaaaaaaaaaaaaaaaaaaaaaaaaaaaaaaa

SEQ ID NO: 810 - DNA, 3657 bp, H. sapiens
agtaatgccccgtatccccctaggaagccgggaagccaagctctgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacactatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgacatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattccatggtgagcacatggacaggaccaccagccatgaagtcactcttcactaggatgttttgttgtaaaagttgtccaaacattgtgaaaacaaacaactttatgagctttcaaagttattttctacagaagactatgccagttgcaatggctttattaagagatgttcataatctttgtcctaaagaagtcttaacgtttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaagtatcggccagctagctcccgatctgctttaataccccagcactcagcaggctgcgacagcacacccaccacaaaaccccagtggagtttggaacttgcacggaagggaacaggtaaagaacaagcacctttggagatgagtatgcatccggcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactga

SEQ ID NO: 811 - DNA, 1095 bp, H. sapiens
atgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacgagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaaaaaaaaaaaaaa

SEQ ID NO: 812 - DNA, 1879 bp, H. sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcgtttgtaattgtaaagcctcaaaagacaactgttcctactatgtaattatagacagaaataaaaacttcagatc

SEQ ID NO: 813 - DNA, 828 bp, H. sapiens
tagtcgcaccaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtcctttggttctc

SEQ ID NO: 814 - DNA, 1541 bp, H. sapiens
ccgagccccagcccggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccggcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctagataggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtg

SEQ ID NO: 815 - DNA, 1925 bp, H. sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 816 - skipped

SEQ ID NO: 817 - DNA, 5212 bp, H. sapiens
cttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacactagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagt

SEQ ID NO: 818 - DNA, 3023 bp, H. sapiens
tgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaacagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctagaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattgggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgaaaaaaaaaaaaaac

SEQ ID NO: 819 - DNA, 4793 bp, H. sapiens
cgtgggcacctccagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggatttttttttttttttttggcttttgtttttgtttgtttttttgtttcgtttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactga

SEQ ID NO: 820 - DNA, 2397 bp, H. sapiens
ttagctaggcatggtggcacatgcctgtaatcccagctactcgggaggctgaggcaggagaattgcttgaacccgggaggcagaggttgcagccggctgagatggcgccatcacactccagcctgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggatacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaagaaaactttaaaaaaactcccattaaaaacaaaacatctttgtgttgtgaacaaaggaattttcaatatttgattggtattctgttctgaagtctaggatatttttcagcctataaagccccctgttttatgcccttctaattctgatgtttgggtattgtgtgagtgcatgtgtttttttttttttttttttaaagcgtgtgtgaacaaatggaaataaagcagggactgtg

SEQ ID NO: 821 - DNA, 1993 bp, H. sapiens
ctagttaaggcggcacagggccgaggcgtagtgtgggtgactcctccgttccttgggtcccgtcgtctgtgatactgcagttcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgcgacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataag

SEQ ID NO: 822 - DNA, 5231 bp, H. sapiens
aagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagagagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacatatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaactatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaagccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcagttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacgtcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagctgcagtgagccgagattgcaccactgcagttcagcctggatgatgagagtgagactccatcgc

SEQ ID NO: 823 - DNA, 1017 bp, H. sapiens
atgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccgccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaa

SEQ ID NO: 824 - DNA, 3069 bp, H. sapiens
tgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggaccaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgatactggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggctttcccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatcctttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 825 - DNA, 6189 bp, H. sapiens
atgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagattcagatccaggacatacaagtgaaaattggggggagagacttatatcttcttacaggacatactcagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatag

SEQ ID NO: 826 - DNA, 2984 bp, H. sapiens
gaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagg

SEQ ID NO: 827 - DNA, 5073 bp, H. sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcaaaaaaaaaaaaaaaaaa

SEQ ID NO: 828 - DNA, 1249 bp, H. sapiens
ggcacgagccagggtttcctcttcaagtaggtctaaaacattttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcccgaggcacgtaccacaacaagtccttcttcaccgacgatgacaagcaagaccacctcagctgggagtggaacctgtcgattaagaaggagtggacagaatgaatgcatccaccccgttccccacccttgccacctggaagaattctctcaggcgtgttcagcaccctgtccctcctccctgtccacagctgggtccctcttcaacactgccacatttccttattgatcgatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtg

SEQ ID NO: 829 - DNA, 1656 bp, H. sapiens
cgcccctgctctcgcgccggcgtcggctgcgtctccggcgtttgaattgcgcttccgccatctttccagcctcagtcggacgggcgcggaggcgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgctttatctgtgggatgctgaaggagatgagtgggcttcggagtgaatgtggcagtttaaaaaataacttcattgtttggacctgcatatttagctgtttggacgcagttgattccttgagtttcatatataagactgctgcagtcacatcacaatattcagtggtgaaatcttgtttgttactgtcattcccattccttttctttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcactttttgtttgaatgttagatgcttagtgtgaagttgatacgcaagccg

SEQ ID NO: 830 - DNA, 1358 bp, H. sapiens
  misc_feature 852: n = A,T,C or G
tgagctgccgtagcggacccagcacagccaggagcgtccgggatgagctcagccgcggccgaccactgggcgtggttgctggtgctcagcttcgtgtttggatgcaatgttcttaggatcctcctcccgtccatctcatccttcatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatgtgaaagctcggacagctcaattagccaagataaaatgggtgataagtgtcgctttctacgtattgcaggctgccctgatgatctcactcatttggaagtattattctgtccctgtggctgtcgtgccgagtaaatggataacccctctagaccgcctggtagcctttcctactagagtagcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagatagtcttataagaatcacgattttctacacctgtcattgagccaagaaagtccagtttatgacacgtatgtactagtgaacaccgtcctcgatctgtcgaaatgtgaaatgtttagggacatctccatgctgtnacttgtgatttgccctcttatgtattttggtcatattgccaactggaaagtcaaaattttaacaactttaagtaagttctttgaagacttagtgctgtttttaatccagttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaaggctgttaatttttcattacagtgttttgtaaatgtatccacgagaccatgatgtcattgttttgtgctcaacttgtgttttgtatttaaagcattttgaatgaagtgtattttataagcatttaatatttatgctctttagaatggaacacagaaaacaaaccttataagcctgattaaattaatctgaaccaaaaaaaaaaaaaaaaaaaaaaaaaaaaaa

SEQ ID NO: 831 - DNA, 2424 bp, H. sapiens
gtgggctcgtcggagccgcgggcggtcagcaggaatttgaccctctagggcatgaatactgtgctgttcagttctgagctgtgctagcaatacccttcaaaggaagagcaatggctgcagcagcagcttctcacctgaacctggatgccctccgggaagtgctagaatgccccatctgcatggagtccatcacagaagagcagctgcgtcccaagcttctgcactgtggccataccatctgccgccagtgcctggagaagctattggccagtagcatcaatggtgtccgctgtcccttttgcagcaagattacccgcataaccagcttgacccagctgacagacaatctgacagtgctaaagatcattgatacagctgggctcagcgaggctgtggggctgctcatgtgtcggtcctgtgggcggcgtctgccccggcaattctgccggagctgtggtttggtgttatgtgagccctgccgggaggcagaccatcagcctcctggccactgtacactccctgtcaaagaagcagctgaggagcggcgtcgggactttggagagaagttaactcgtctgcgggaacttatgggggagctgcagcggcggaaggcagccttggaaggtgtctccaaggaccttcaggcaaggtataaagcagttctccaggagtatgggcatgaggagcgcagggtccaggatgagctggctcgctctcggaagttcttcacaggctctttggctgaagttgagaagtccaatagtcaagtggtagaggagcagagttacctgcttaacattgcagaggtgcaggctgtgtctcgctgtgactacttcctggccaagatcaagcaggcagatgtagcactactggaggagacagctgatgaggaggagccagagctcactgccagcttgcctcgggagctcaccctgcaagatgtggagctccttaaggtaggtcatgttggccccctccaaattggacaagctgttaagaagccccggacagttaacgtggaagattcctgggccatggaggccacagcgtctgctgcctctacctctgttacttttagagagatggacatgagcccggaggaagtggttgccagccctagggcctcacctgctaaacagcggggtcctgaggcagcctccaatatccagcagtgcctctttctcaagaagatgggggccaaaggcagcactccaggaatgttcaatcttccagtcagtctctacgtgaccagtcaaggtgaagtactagtcgctgaccgtggtaactatcgtatacaagtctttacccgcaaaggctttttgaaggaaatccgccgcagccccagtggcattgatagctttgtgctaagcttccttggggcagatctacccaacctcactcctctctcagtggcaatgaactgccaggggctgattggtgtgactgacagctatgataactccctcaaggtatataccttggatggccactgcgtggcctgtcacaggagccagctgagcaaaccatggggtatcacagccttgccatctggccagtttgtagtaaccgatgtggaaggtggaaagctttggtgtttcacagttgatcgaggatcaggggtggtcaaatacagctgcctatgtagtgctgtgcggcccaaatttgtcacctgtgatgctgagggcaccgtctacttcacccagggcttaggcctcaatctggagaatcggcagaatgagcaccacctggagggtggcttttccattggctctgtaggccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggcgggggctatagtgtccttattcgagagggacttacctgtccggtgggcatagccctaactcctaaggggcagctgctggtcttggactgttgggatcattgcatcaagatctacagctaccatctgagaagatattccaccccataggggatgagaaattatcagtttcttctgctcccaagccaacttcccttcccttagttcttggttgttagtggcacatgcagaatagactcagcctatgtcctgattccagctgggtagttctagaactttagaagctccatcttttaatgtttttatttgttatgtccccctcccggcttcccacctaaatttagagctttaaaagatgcactgcccaaataggacacacgatggtgttagctgaagtttgattagcaattaggcacttccaaggctttagtagagagagccactttagccctttgtgccatgtttgaaatttgcccttgtattaaatccttgattttttccc

SEQ ID NO: 832 - DNA, 5967 bp, H. sapiens
cctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgatccagtctctggccagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacaatagtgcagaatacctggaaatgtgtaataccttctttttctattatgtttgtggactaatgtgatgattgagatgttctcactgtgatttcaacaacctataagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccacctaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaaaaaa

SEQ ID NO: 833 - DNA, 5066 bp, H. sapiens
ggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaggttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaagagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacaacaacacagttacatagtaaaaggaggcctaaaatatgtgggcctcgctatggtgaaaccaaagaaaaagatattgactggggaaaactctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaaatggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaa

SEQ ID NO: 834 - skipped

SEQ ID NO: 835 - DNA, 2352 bp, H. sapiens
ggcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagttttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttgattactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtaaaaaaaaaaaaaaaaaaaaaaaaaaaaaa

SEQ ID NO: 836 - DNA, 699 bp, H. sapiens
catccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgacacttactgctagctctgctttttatgacaggagaaaagcccagagttcactgtgtgtcagaacaactttctaacaaacatttattaatccagcctctgcctttcattaaatgtaaccttttgctttccaaattaaagaactccatgccactcctcaaaaaaaaaaaaaa

SEQ ID NO: 837 - DNA, 4745 bp, H. sapiens
aattagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgcaaaaaaaaaaaaaaaaaaatggccacaacagttgcacagtgcccaccctatggcctagcttcaggtacttcagttgaagtctaaactcaggtaacttggaatgtatatcatattgggatattaaatatttcacagctaaaaagctaaagagggaacatcactcttttgcctttccttattttatgcatttccctttcctcattacattccacattcttagaataagaagtgcattcaatcctaggagaatgataatcctggacatgggtgaacatgaggagaaccagcaaaatctgtggtgtttgacatcactttgtcatgtggttacaagtaaaacaactgttgcattcactgtttcaacatgtgtacatgtggcttttttaaaagttcaggtgttgctcagtaaaggactgtgacaatgttgcaaataaagtgttcagtactggactgtacataaacattccacattgtgtgtgatgaaatttaaagacaagaatgtctagagttaatttcaaaataagtgaagtgtttgacggaatggttgagatttttttgtttatgttagccatcagggtcataactgttaccattttatctaaagacatatttatatttagtttctcccttggaaattctttattttgcaggtgaaaaagtgacatactttttgttattgtcttcctcaagcagtttaggtgcatgatcttcatttacatagaatacttgggtctcagaattgatgcaacataagcaggtttttttggtgacttacaagagcaatagtttgaagctatctcatttaagcctctcataatgcataatcatgagtagttttgaaatttgcaacctgtgaggtagagcataaactcaagaaaatagccttgaacttgcagacttttgacacaagttctccacaaagtgtgaagagagccccaggcattcctgattggtcaatgggagagcctaactttcattgttttcttcagtacaaagagtatccaaaagctaagtttttgtattccactactttcagttcaataaaacctagagttgtttcatctgcgcctaaagtgtatggcacaattttcttaagaattaggggaaccaggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagtgttatattgtaggagactgtcatggaaaaaaggactcagtttactttcgtcattttcacaggggaaccttttaaaacaatcttttcagcagcagatacctttaaccctaataatctcaggccttgatgaaaatactatattttgtagattatggttaaagggggaaaattactagttccgtaagataaatatgagctccatttgacttctgatgtctggtttagcattacataatatgttgatcttacactctgcttttgtccaaataaaatgcaatagtatcaatatcaatttcagaaaaatggactgaatatgcttttttggtgatgaaatctcatgtacgatatttatagtgatgtgcttttattttctcatgagatactaaatattaattgtgttgtacatttgttcttagcatatattaaagttttgaaccaaatgtgttaaagcttacgctttgccatgtaaatttcccagaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagtaaaactgaaa

SEQ ID NO: 838-839 - skipped (2 entries)

SEQ ID NO: 840 - RNA, 22 nt, Artificial Sequence
  Oligomeric compound
ugcaggccauauugugcugccu

SEQ ID NO: 841 - RNA, 22 nt, Artificial Sequence
  Oligomeric compound
ugcgaaucauuauuugcugcuc

SEQ ID NO: 842 - RNA, 23 nt, Artificial Sequence
  Oligomeric compound
cuccaguauuaacugugcugcug

SEQ ID NO: 843 - RNA, 22 nt, Artificial Sequence
  Oligomeric compound
caccaauauuacugugcugcuu

SEQ ID NO: 844 - DNA, 20 bp, Artificial Sequence
  Oligomeric compound
ctgctagcctctggatttga

SEQ ID NO: 845 - DNA, 21 bp, Artificial Sequence
  Oligomeric compound
actagtttttcttacgtctga

SEQ ID NO: 846 - DNA, 22 bp, Artificial Sequence
  Oligomeric compound
ctagacattagctttgacatcc

SEQ ID NO: 847 - DNA, 20 bp, Artificial Sequence
  Oligomeric compound
ccgagctctcttatcaacag

SEQ ID NO: 848 - DNA, 22 bp, Artificial Sequence
  Oligomeric compound
ctacctgcacgaacagcacttt

SEQ ID NO: 849 - DNA, 20 bp, Artificial Sequence
  Oligomeric compound
tactttatatagaacacaag

SEQ ID NO: 850-851 - skipped (2 entries)

SEQ ID NO: 852 - DNA, 23 bp, Artificial Sequence
  Oligomeric compound
cacaggttaaagggtctcaggga

SEQ ID NO: 853 - DNA, 22 bp, Artificial Sequence
  Oligomeric compound
agccaagctcagacggatccga

SEQ ID NO: 854 - DNA, 22 bp, Artificial Sequence
  Oligomeric compound
ggagtgaagacacggagccaga

SEQ ID NO: 855 - DNA, 22 bp, Artificial Sequence
  Oligomeric compound
tgctcaataaatacccgttgaa

SEQ ID NO: 856 - DNA, 20 bp, Artificial Sequence
  Oligomeric compound
ccctgggtataactcccaaa

SEQ ID NO: 857 - DNA, 20 bp, Artificial Sequence
  Oligomeric compound
tcggttctttccaaggctga

SEQ ID NO: 858 - DNA, 20 bp, Artificial Sequence
  Oligomeric compound
atccctttcttccgcatgtg

SEQ ID NO: 859 - DNA, 20 bp, Artificial Sequence
  Oligomeric compound
gccaaggcgtgacatgatat

SEQ ID NO: 860 - DNA, 4764 bp, H. sapiens
ctgtcttggtacctgcggtagtagcctggctttgctctgacggcgatctcgcggcccgagagccttttataggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatccatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacactgataaggatttggaatatgttcatactttcatgaatgtctgcttctttccacgattgaaagaattcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagtaaaaaaaaaaaaaaaaaaaaaaa

SEQ ID NO: 861 - DNA, 2737 bp, H. sapiens
cgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtggaggaccccctgccccctgtgttctcaggcacaccaaagggcagtggggctggctacggtgttggctttgacctggaggaattcttaaaccagtctttcgacatgggcgtggctgatgggccacaggatggccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcaaaaaaaaaaaaaaaaaaaaaaaaaaaa

SEQ ID NO: 862 - DNA, 110 bp, Artificial Sequence
  DNA
agcagcgcagcgccctgtctcccagccaaggtggaaccttctgggaagcggtcagttgggagtcccttccctgaaggttcctccttggaagagagaagttgttctgcagc

SEQ ID NO: 863 - RNA, 20 nt, Artificial Sequence
  Oligomeric compound
ccuucccugaagguuccucc

SEQ ID NO: 864 - RNA, 20 nt, Artificial Sequence
  Oligomeric compound
ggaggaaccuucagggaagg

SEQ ID NO: 865-870 - skipped (6 entries)

SEQ ID NO: 871 - DNA, 430 bp, Artificial Sequence
  DNA
aggtttggtcctgggtgctcaaatggcaggccacagacaggaaacacagttgtgaggaattacaacagcctcccggccagagctggagaggtggagcccaggtcccctctaacaccccttctcctggccaggttggagtcccgccacaggccaccagagcggagcagcgcagcgccctgtctcccagcctgaggtgcagtgctgcatctctggtcagttgggagtctgagatgaagcactgtagctcaggaagagagaagttgttctgcagccatcagcctggaagtggtaagtgctggggggttgtggggggccataacaggaaggacagagtgtttccagactccatactatcagccacttgtgatgctggggaagttcctctacacaagttcccctggtgccacgatctgcttcacgagtctgggca

SEQ ID NO: 872 - DNA, 1371 bp, H. sapiens
cacgaggcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgaca

SEQ ID NO: 873 - DNA, 2853 bp, H. sapiens
agcgggctgcggcggcggcggcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccatggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccacactgctgctgctatcaacgccagaataaacacactctgtgggtctcactccaaaaaaaaaaaaaaaa

SEQ ID NO: 874 - DNA, 20 bp, Artificial Sequence
  DNA
tgagctacagcttcatctca

SEQ ID NO: 875 - DNA, 21 bp, Artificial Sequence
  DNA
tattctgcaggttcatctcag

SEQ ID NO: 876 - DNA, 41 bp, Artificial Sequence
  DNA
cggcttggattattctgcaggttcatctcagacccaccttt

SEQ ID NO: 877 - DNA, 23 bp, Artificial Sequence
  DNA
ttgagcccagcgctcgcatctca

SEQ ID NO: 878 - DNA, 20 bp, Artificial Sequence
  Oligomeric compound
tataacattgatgtaatatg

SEQ ID NO: 879 - DNA, 20 bp, Artificial Sequence
  Oligomeric compound
tgctactttactccaaggtt

SEQ ID NO: 880 - DNA, 20 bp, Artificial Sequence
  Oligomeric compound
gcaccttttcaaaatccaca

SEQ ID NO: 881 - DNA, 20 bp, Artificial Sequence
  Oligomeric compound
tggcctgcaccttttcaaaa

SEQ ID NO: 882 - DNA, 20 bp, Artificial Sequence
  Oligomeric compound
agcacaatatggcctgcacc

SEQ ID NO: 883 - DNA, 20 bp, Artificial Sequence
  Oligomeric compound
tccttgtatttttgaggcag

SEQ ID NO: 884 - DNA, 20 bp, Artificial Sequence
  Oligomeric compound
agatcagatccttgtatttt

SEQ ID NO: 885 - DNA, 28 bp, Artificial Sequence
  PCR primer
gtgtgtttaaaaaaaataaaaccttgga

SEQ ID NO: 886 - DNA, 19 bp, Artificial Sequence
  PCR primer
tggcctgcaccttttcaaa

SEQ ID NO: 887 - DNA, 27 bp, Artificial Sequence
  PCR probe
aaagtagcagcacataatggtttgtgg

SEQ ID NO: 888 - DNA, 20 bp, Artificial Sequence
  Oligomeric compound
gctactttactccaaggttt

SEQ ID NO: 889 - DNA, 20 bp, Artificial Sequence
  Oligomeric compound
cctgcaccttttcaaaatcc

SEQ ID NO: 890 - DNA, 20 bp, Artificial Sequence
  Oligomeric compound
atatggcctgcaccttttca

SEQ ID NO: 891 - DNA, 20 bp, Artificial Sequence
  Oligomeric compound
acaatatggcctgcaccttt

SEQ ID NO: 892 - DNA, 20 bp, Artificial Sequence
  Oligomeric compound
ggcagcacaatatggcctgc

SEQ ID NO: 893 - DNA, 20 bp, Artificial Sequence
  Oligomeric compound
tgaggcagcacaatatggcc

SEQ ID NO: 894 - DNA, 20 bp, Artificial Sequence
  Oligomeric compound
ttttgaggcagcacaatatg

SEQ ID NO: 895 - DNA, 20 bp, Artificial Sequence
  Oligomeric compound
tatttttgaggcagcacaat

SEQ ID NO: 896 - DNA, 20 bp, Artificial Sequence
  Oligomeric compound
ttgtatttttgaggcagcac

SEQ ID NO: 897 - DNA, 20 bp, Artificial Sequence
  Oligomeric compound
agatccttgtatttttgagg

SEQ ID NO: 898 - DNA, 20 bp, Artificial Sequence
  Oligomeric compound
agaagatcagatccttgtat

SEQ ID NO: 899 - DNA, 20 bp, Artificial Sequence
  Oligomeric compound
ttcagaagatcagatccttg

SEQ ID NO: 900 - DNA, 20 bp, Artificial Sequence
  Oligomeric compound
aaatatattttcttcagaag

SEQ ID NO: 901 - DNA, 20 bp, Artificial Sequence
  Oligomeric compound
cgttattaacctccgttgaa

SEQ ID NO: 902 - DNA, 20 bp, Artificial Sequence
  Oligomeric compound
atgcatactacgaaaggccg

SEQ ID NO: 903 - DNA, 28 bp, Artificial Sequence
  PCR primer
cctacatttttgaggccttaaagtactg

SEQ ID NO: 904 - DNA, 26 bp, Artificial Sequence
  PCR primer
caaataatgattcgcatcttgactgt

SEQ ID NO: 905 - DNA, 24 bp, Artificial Sequence
  PCR probe
agcagcacatcatggtttacatgc

SEQ ID NO: 906 - DNA, 310 bp, H. sapien
aaataattatgcatattacatcaatgttataatgtttaaacatagatttttttacatgcattctttttttcctgaaagaaaatattttttatattctttaggcgcgaatgtgtgtttaaaaaaaataaaaccttggagtaaagtagcagcacataatggtttgtggattttgaaaaggtgcaggccatattgtgctgcctcaaaaatacaaggatctgatcttctgaagaaaatatatttctttttattcatagctcttatgatagcaatgtcagcagtgccttagcagcacgtaaatattggcgttaag

SEQ ID NO: 907 - DNA, 20 bp, Artificial Sequence
  Oligomeric compound
ttagaatacgtcgcgttatg

SEQ ID NO: 908 - DNA, 15 bp, Artificial Sequence
  PCR primer
ccctgggctctgcct

SEQ ID NO: 909 - DNA, 23 bp, Artificial Sequence
  PCR primer
tgtacacaaaccaactgtgtttc

SEQ ID NO: 910 - DNA, 14 bp, Artificial Sequence
  PCR probe
cgtgcctactgagc

SEQ ID NO: 911 - DNA, 20 bp, Artificial Sequence
  PCR primer
gctgtaccaccttgtcgggt

SEQ ID NO: 912 - DNA, 19 bp, Artificial Sequence
  PCR primer
tcgactggtgttgccatga

SEQ ID NO: 913 - DNA, 28 bp, Artificial Sequence
  PCR probe
cttatcagactgatgttgactgttgaat

SEQ ID NO: 914 - DNA, 281 bp, H. sapiens
ctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtatctttcatctgaccatccatatccaatgttctcatttaaacattacccagcatcattgtttataatcagaaactctggtccttctgtctggtggcac

SEQ ID NO: 915 - DNA, 20 bp, Artificial Sequence
  Oligomeric compound
acaagcagacagtcaggcag

SEQ ID NO: 916 - DNA, 20 bp, Artificial Sequence
  Oligomeric compound
ggtaggcaaaacaagcagac

SEQ ID NO: 917 - DNA, 20 bp, Artificial Sequence
  Oligomeric compound
ggagatgtcacgatggtagg

SEQ ID NO: 918 - DNA, 20 bp, Artificial Sequence
  Oligomeric compound
aggtggtacagccatggaga

SEQ ID NO: 919 - DNA, 20 bp, Artificial Sequence
  Oligomeric compound
gataagctacccgacaaggt

SEQ ID NO: 920 - DNA, 20 bp, Artificial Sequence
  Oligomeric compound
agtctgataagctacccgac

SEQ ID NO: 921 - DNA, 20 bp, Artificial Sequence
  Oligomeric compound
caacagtcaacatcagtctg

SEQ ID NO: 922 - DNA, 20 bp, Artificial Sequence
  Oligomeric compound
gagattcaacagtcaacatc

SEQ ID NO: 923 - DNA, 20 bp, Artificial Sequence
  Oligomeric compound
ctggtgttgccatgagattc

SEQ ID NO: 924 - DNA, 20 bp, Artificial Sequence
  Oligomeric compound
catcgactggtgttgccatg

SEQ ID NO: 925 - DNA, 20 bp, Artificial Sequence
  Oligomeric compound
acagcccatcgactggtgtt

SEQ ID NO: 926 - DNA, 20 bp, Artificial Sequence
  Oligomeric compound
tgtcagacagcccatcgact

SEQ ID NO: 927 - DNA, 20 bp, Artificial Sequence
  Oligomeric compound
ccaaaatgtcagacagccca

SEQ ID NO: 928 - DNA, 20 bp, Artificial Sequence
  Oligomeric compound
gataccaaaatgtcagacag

SEQ ID NO: 929 - DNA, 20 bp, Artificial Sequence
  Oligomeric compound
ggtcagatgaaagataccaa

SEQ ID NO: 930 - DNA, 20 bp, Artificial Sequence
  Oligomeric compound
aacattggatatggatggtc

SEQ ID NO: 931 - DNA, 20 bp, Artificial Sequence
  Oligomeric compound
taatgtttaaatgagaacat

SEQ ID NO: 932 - DNA, 20 bp, Artificial Sequence
  Oligomeric compound
aacaatgatgctgggtaatg

SEQ ID NO: 933 - DNA, 20 bp, Artificial Sequence
  Oligomeric compound
gagtttctgattataaacaa

SEQ ID NO: 934 - DNA, 20 bp, Artificial Sequence
  Oligomeric compound
cgacaaggtggtacagccat

SEQ ID NO: 935 - DNA, 20 bp, Artificial Sequence
  Oligomeric compound
gaaagataccaaaatgtcag

SEQ ID NO: 936 - DNA, 20 bp, Artificial Sequence
  Oligomeric compound
acgctagcctaatagcgagg

SEQ ID NO: 937 - DNA, 20 bp, Artificial Sequence
  Oligomeric compound
gactgttgaatctcatggca

SEQ ID NO: 938 - DNA, 18 bp, Artificial Sequence
  Oligomeric compound
agacacgtgcactgtaga

SEQ ID NO: 939 - DNA, 20 bp, Artificial Sequence
  Oligomeric compound
aggtagctttgattatgtaa

SEQ ID NO: 940 - DNA, 20 bp, Artificial Sequence
  Oligomeric compound
agcccattgctggacatgca

SEQ ID NO: 941 - DNA, 3413 bp, H. sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccg

SEQ ID NO: 942-944 - skipped (3 entries)

SEQ ID NO: 945 - RNA, 80 nt, H. sapiens
ccuguugccacaaacccguagauccgaacuugugguauuaguccgcacaagcuuguaucuauagguaugugucuguuagg

SEQ ID NO: 946 - RNA, 75 nt, H. sapiens
ugcccuggcucaguuaucacagugcugaugcugucuauucuaaagguacaguacugugauaacugaaggauggca

SEQ ID NO: 947 - RNA, 75 nt, H. sapiens
uguccuuuuucgguuaucaugguaccgaugcuguauaucugaaagguacaguacugugauaacugaagaauggug

SEQ ID NO: 948 - RNA, 81 nt, H. sapiens
cuucaggaagcugguuucauauggugguuuagauuuaaauagugauugucuagcaccauuugaaaucaguguucuuggggg

SEQ ID NO: 949 - RNA, 81 nt, H. sapiens
cuucuggaagcugguuucacaugguggcuuagauuuuuccaucuuuguaucuagcaccauuugaaaucaguguuuuaggag

SEQ ID NO: 950 - RNA, 78 nt, H. sapiens
uacugcccucggcuucuuuacagugcugccuuguugcauauggaucaagcagcauuguacagggcuaugaaggcauug

SEQ ID NO: 951 - RNA, 81 nt, H. sapiens
ccuuggccauguaaaagugcuuacagugcagguagcuuuuugagaucuacugcaauguaagcacuucuuacauuaccaugg

SEQ ID NO: 952 - RNA, 81 nt, H. sapiens
cucucugcuuucagcuucuuuacaguguugccuuguggcauggaguucaagcagcauuguacagggcuaucaaagcacaga

SEQ ID NO: 953 - RNA, 81 nt, H. sapiens
gcagugccuuagcagcacguaaauauuggcguuaagauucuaaaauuaucuccaguauuaacugugcugcugaaguaaggu

SEQ ID NO: 954 - RNA, 81 nt, H. sapiens
guuccacucuagcagcacguaaauauuggcguagugaaauauauauuaaacaccaauauuacugugcugcuuuagugugac

SEQ ID NO: 955 - RNA, 81 nt, H. sapiens
uuuuuguucuaaggugcaucuagugcagauagugaaguagauuagcaucuacugcccuaagugcuccuucuggcauaagaa

SEQ ID NO: 956 - RNA, 80 nt, H. sapiens
caguccucuguuaguuuugcauaguugcacuacaagaagaauguaguugugcaaaucuaugcaaaacugaugguggccug

SEQ ID NO: 957 - RNA, 80 nt, H. sapiens
uucuaugguuaguuuugcagguuugcauccagcugugugauauucugcugugcaaauccaugcaaaacugacugugguag

SEQ ID NO: 958 - RNA, 81 nt, H. sapiens
uuacaauuaguuuugcagguuugcauuucagcguauauauguauauguggcugugcaaauccaugcaaaacugauugugau

SEQ ID NO: 959 - RNA, 81 nt, H. sapiens
accuugucggguagcuuaucagacugauguugacuguugaaucucauggcaacaccagucgaugggcugucugacauuuug

SEQ ID NO: 960 - RNA, 81 nt, H. sapiens
ccacggccggcugggguuccuggggaugggauuugcuuccugucacaaaucacauugccagggauuuccaaccgacccuga

SEQ ID NO: 961 - RNA, 81 nt, H. sapiens
cccugggcucugccucccgugccuacugagcugaaacacaguugguuuguguacacuggcucaguucagcaggaacagggg

SEQ ID NO: 962 - RNA, 82 nt, H. sapiens
ucagaauaaugucaaagugcuuacagugcagguagugauaugugcaucuacugcagugaaggcacuuguagcauuaugguga

SEQ ID NO: 963 - RNA, 78 nt, H. sapiens
cuuucuacacagguugggaucgguugcaaugcuguguuucuguaugguauugcacuugucccggccuguugaguuugg

SEQ ID NO: 964 - RNA, 78 nt, H. sapiens
uggccgauuuuggcacuagcacauuuuugcuugugucucuccgcucugagcaaucaugugcagugccaauaugggaaa

SEQ ID NO: 965 - RNA, 80 nt, H. sapiens
gugagcgacuguaaacauccucgacuggaagcugugaagccacagaugggcuuucagucggauguuugcagcugccuacu

SEQ ID NO: 966 - RNA, 80 nt, H. sapiens
gugagguaguaaguuguauuguugugggguagggauauuaggccccaauuagaagauaacuauacaacuuacuacuuucc

SEQ ID NO: 967 - RNA, 78 nt, H. sapiens
aaaugucagacagcccaucgacugguguugccaugagauucaacagucaacaucagucugauaagcuacccgacaagg

SEQ ID NO: 968 - RNA, 81 nt, H. sapiens
ugugcaucguggucaaaugcucagacuccugugguggcugcucaugcaccacggauguuugagcaugugcuacggugucua

SEQ ID NO: 969 - RNA, 80 nt, H. sapiens
ccugaggagcagggcuuagcugcuugugagcaggguccacaccaagucguguucacaguggcuaaguuccgccccccagg

SEQ ID NO: 970 - RNA, 75 nt, H. sapiens
ucaucccuggguggggauuuguugcauuacuuguguucuauauaaaguauugcacuugucccggccuguggaaga

SEQ ID NO: 971 - RNA, 80 nt, H. sapiens
cugggggcuccaaagugcuguucgugcagguagugugauuacccaaccuacugcugagcuagcacuucccgagcccccgg

SEQ ID NO: 972 - RNA, 81 nt, H. sapiens
aacacagugggcacucaauaaaugucuguugaauugaaaugcguuacauucaacggguauuuauugagcacccacucugug

SEQ ID NO: 973 - RNA, 81 nt, H. sapiens
cccauuggcauaaacccguagauccgaucuuguggugaaguggaccgcacaagcucgcuucuaugggucugugucagugug

SEQ ID NO: 974 - RNA, 143 nt, H. sapiens
cucccucacaggacagcugaacuccgggacuggccaguguugagaggcggagacuugggcaauugcuggacgcugcccugggcauugcacuugucucggucugacagugccggcccaacacugcggaugcuggggggaggggg

SEQ ID NO: 975 - RNA, 101 nt, H. sapiens
uuuaaaaugguccuugcccucaaggagcucacagucuauugaguuaccuuucugacuuucccacuagauugugagcuccuggagggcaggcacuuucguuc

SEQ ID NO: 976 - RNA, 106 nt, H. sapiens
cuccuguaacuuggaacuggagaggaggcaagaugcuggcauagcuguugaacugggaaccugcuaugccaacauauugccaucuuuccugucugacagcagccau

SEQ ID NO: 977 - RNA, 101 nt, H. sapiens
uucugcuugcucugguggagauauugcacauuacuaaguugcauguugucacggccucaaugcaauuuagugugugugauauuuucacaugagugcaugca

SEQ ID NO: 978 - RNA, 93 nt, H. sapiens
ggccggcgcccgagcucuggcuccgugucuucacucccgugcuuguccgaggagggagggagggacgggggcugugcuggggcagcuggaaca

SEQ ID NO: 979 - RNA, 101 nt, H. sapiens
aaccaugcuguaguguguguaaacauccuacacucucagcugugagcucaagguggcugggagaggguuguuuacuccuucugccauggaaaacaucagcu

SEQ ID NO: 980 - RNA, 96 nt, H. sapiens
uccuggguccuggcacccacccguagaaccgaccuugcggggccuucgccgcacacaagcucgugucuguggguccgugucgggggcucaccaucg

SEQ ID NO: 981 - RNA, 72 nt, H. sapiens
ucuaggucccugagacccuuuaaccugugaggacauccagggucacaggugagguucuugggagccuggcgu

SEQ ID NO: 982 - RNA, 81 nt, H. sapiens
gacuuuuccuagucccugagacccuaacuugugagguauuuuaguaacaucacaagucaggcucuugggaccuaggcggag

SEQ ID NO: 983 - RNA, 99 nt, H. sapiens
cccauagaggcuguggcuggauucaaguaauccaggauaggcuguuuccaucugugaggccuauucuugauuacuuguuucuggaggcagcugaugguc

SEQ ID NO: 984 - RNA, 77 nt, H. sapiens
ucuccagccugcugaagcucagagggcucugauucagaaagaucaucggauccgucugagcuuggcuggucggaagu

SEQ ID NO: 985 - RNA, 91 nt, H. sapiens
uggaugagcccucggaggacuccauuuguuuugaugauggauucuuaugcuccaucaucgucucaaaugagucuucagaggguucuaucau

SEQ ID NO: 986 - RNA, 84 nt, H. sapiens
gugguacuugaagauagguuauccguguugccuucgcuuuauuugugacgaaucauacacgguugaccuauuuuucaguaccaa

SEQ ID NO: 987 - RNA, 81 nt, H. sapiens
ccguggccucguucaaguaauccaggauaggcugugcaggucccaaugggccuauucuugguuacuugcacggggacgcgg

SEQ ID NO: 988 - RNA, 88 nt, H. sapiens
auugcuuguaacuuuccaaagaauucuccuuuugggcuuucugguuuuauuuuaagcccaaaggugaauuuuuugggaaguuugagcu

SEQ ID NO: 989 - RNA, 65 nt, H. sapiens
gguucugaucauugguccagaggggagauagguuccugugauuuuuccuucuucucuauagaaua

SEQ ID NO: 990 - RNA, 102 nt, H. sapiens
cgccaacggcuggacagcgggcaacggaaucccaaaagcagcuguugucuccagagcauuccagcugcgcuuggauuucguccccugcucuccugccugagc

SEQ ID NO: 991 - RNA, 84 nt, H. sapiens
gcuucccgaggccacaugcuucuuuauauccccauauggauuacuuugcuauggaauguaaggaagugugugguuucggcaagu

SEQ ID NO: 992 - RNA, 88 nt, H. sapiens
agcccugccggggcuaaagugcugacagugcagauagugguccucuccgugcuaccgcacuguggguacuugcugcuccagcagggca

SEQ ID NO: 993 - RNA, 85 nt, H. sapiens
ccagucacguccccuuaucacuuuuccagcccagcuuugugacuguaaguguuggacggagaacugauaaggguaggugauugac

SEQ ID NO: 994 - RNA, 87 nt, H. sapiens
agcuucccuggcucuagcagcacagaaauauuggcacagggaagcgagucugccaauauuggcugugcugcuccaggcaggguggug

SEQ ID NO: 995 - RNA, 82 nt, H. sapiens
augggagcugagggcugggucuuugcgggcgagaugagggugucggaucaacuggccuacaaagucccaguucucggccccc

SEQ ID NO: 996 - RNA, 82 nt, H. sapiens
agggggcgagggauuggagagaaaggcaguuccugaugguccccuccccaggggcuggcuuuccucugguccuucccuccca

SEQ ID NO: 997 - RNA, 91 nt, H. sapiens
ucccugcucccucucucacaucccuugcaugguggagggugagcuuucugaaaaccccucccacaugcaggguuugcaggauggcgagccu

SEQ ID NO: 998 - RNA, 78 nt, H. sapiens
ggggcugugccggguagagagggcagugggagguaagagcucuucacccuucaccaccuucuccacccagcauggccg

SEQ ID NO: 999 - RNA, 113 nt, H. sapiens
cuuauauguuuaaugguguuaucaaguguaacagcaacuccauguggacuguguaccaauuuccaguggagaugcuguuacuuuugaugguuaccaacuugcuacaauauaaa

SEQ ID NO: 1000 - RNA, 83 nt, H. sapiens
uuccugugacgggcgagcuuuuggcccggguuauaccugaugcucacguauaagacgagcaaaaagcuuguuggucagaggag

SEQ ID NO: 1001 - RNA, 91 nt, H. sapiens
aauugguucccgcccccuguaacagcaacuccauguggaagugcccacugguuccaguggggcugcuguuaucuggggcgagggccaguac

SEQ ID NO: 1002 - RNA, 98 nt, H. sapiens
gggacuggcucagguguauucuacagugcacgugucuccaguguggcucggaggcuggagacgcggcccuguuggaguaacaacugaagccggagucu

SEQ ID NO: 1003 - RNA, 71 nt, H. sapiens
guggccaucuuacugggcagcauuggauggagucaggucucuaauacugccugguaaugaugacggcggag

SEQ ID NO: 1004 - RNA, 89 nt, H. sapiens
cgggccccugugagcaucuuaccggacagugcuggauuucccagcuugacucuaacacugucugguaacgauguucaaaggugacccgc

SEQ ID NO: 1005 - RNA, 81 nt, H. sapiens
uugagcgggggucaagagcaauaacgaaaaauguuugucauaaaccguuuuucauuauugcuccugaccuccucucauuug

SEQ ID NO: 1006 - RNA, 87 nt, H. sapiens
cagagccuggagugggggggcaggaggggcucagggagaaagugcauacagccccuggcccucucugcccuuccguccccugcucuu

SEQ ID NO: 1007 - RNA, 83 nt, H. sapiens
ugacuaugccuccccgcauccccuagggcauugguguaaagcuggagacccacugccccaggugcugcuggggguuguagucu

SEQ ID NO: 1008 - RNA, 89 nt, H. sapiens
acggcuguccucuccaacaauauccuggugcugagugaugacucaggcgacuccagcaucagugauuuuguugaagagggcagcugcca

SEQ ID NO: 1009 - RNA, 82 nt, H. sapiens
ugguacuuggagagaggugguccguggcgcguucgcuuuauuuauggcgcacauuacacggucgaccucuuugcaguaucua

SEQ ID NO: 1010 - RNA, 102 nt, H. sapiens
gaaacugggcucaaggugaggggugcuaucugugauugagggacaugguuaauggaauugucucacacagaaaucgcacccgucaccuuggccuacuuauca

SEQ ID NO: 1011 - RNA, 91 nt, H. sapiens
aucuaugaaggccaaguggaggugacuggugaugaauacaauguggaaagcauugauggucagccaggugccuucaccugcuauuuggaug

SEQ ID NO: 1012 - RNA, 97 nt, H. sapiens
cagugcuuucagcaagagggugguaccacaugucuucaaaaugaaacgucucuuggagacaaacaugcuacucucacugcaguugaaaaaagucaca

SEQ ID NO: 1013 - RNA, 90 nt, H. sapiens
auggugugguggggcagcugguguugugaaucaggccguugccaaucagagaacggcuacuucacaacaccagggccacaccacacuaca

SEQ ID NO: 1014 - RNA, 86 nt, H. sapiens
ggaaucagauuagcugguguugugaaucuccaucugaacuaagauggacaguaagagaaucccaauaucuuaguaaaucuguuacu

SEQ ID NO: 1015 - RNA, 84 nt, H. sapiens
auggcugcacucaacauucauugcugucgguggguuugagucugaaucaacucacugaucaaugaaugcaaacugcggaccaaa

SEQ ID NO: 1016 - RNA, 89 nt, H. sapiens
gggccgcggcuccugauuguccaaacgcaauucucgagucuauggcuccggccgagaguugagucuggacgucccgagccgccgccccc

SEQ ID NO: 1017 - RNA, 88 nt, H. sapiens
ugugugugcaucguggucaaaugcucagacuccugugguggcugcuuaugcaccacggauguuugagcaugugcuauggugucuacuu

SEQ ID NO: 1018 - RNA, 95 nt, H. sapiens
ucuuccagucauccugagguagauaucauacaggaaugcuggggccuuauggcuuacagcaauccaguaaugauauaaaagaugauuggagguua

SEQ ID NO: 1019 - RNA, 66 nt, H. sapiens
acgcaguccugucagacuuuguucgguccacgggggcagaaccuggucuggccagagaccugcugg

SEQ ID NO: 1020 - RNA, 78 nt, H. sapiens
uugugcuuucagcuucuuuacagugcugccuuguagcauucaggucaagcagcauuguacagggcuaugaaagaacca

SEQ ID NO: 1021 - RNA, 72 nt, H. sapiens
aaucuaaagacaacauuucugcacacacaccagacuauggaagccaguguguggaaaugcuucugcuagauu

SEQ ID NO: 1022 - RNA, 81 nt, H. sapiens
gggcuuucaagucacuagugguuccguuuaguagaugauugugcauuguuucaaaauggugcccuagugacuacaaagccc

SEQ ID NO: 1023 - RNA, 73 nt, H. sapiens
cagggugugugacugguugaccagaggggcaugcacuguguucacccugugggccaccuagucaccaacccuc

SEQ ID NO: 1024 - RNA, 99 nt, H. sapiens
ccgauguguauccucagcuuugagaacugaauuccauggguugugucagugucagaccucugaaauucaguucuucagcugggauaucucugucaucgu

SEQ ID NO: 1025 - RNA, 84 nt, H. sapiens
cuccccauggcccugucucccaacccuuguaccagugcugggcucagacccugguacaggccugggggacagggaccuggggac

SEQ ID NO: 1026 - RNA, 96 nt, H. sapiens
ugggcagucuuugcuacuguaaacauccuugacuggaagcuguaagguguucagaggagcuuucagucggauguuuacagcggcaggcugccacgg

SEQ ID NO: 1027 - RNA, 75 nt, H. sapiens
gacccuuccagagggcccccccucaauccuguugugccuaauucagaggguuggguggaggcucuccugaagggc

SEQ ID NO: 1028 - RNA, 79 nt, H. sapiens
cgguacuugaagaaaugguuuaccgucccacauacauuuugaauauguaugugggaugguaaaccgcuucuugguaucc

SEQ ID NO: 1029 - RNA, 89 nt, H. sapiens
uuacugcuaacgaaugcucugacuuuauugcacuacuguacuuuacagcuagcagugcaauaguauugucaaagcaucugaaagcagga

SEQ ID NO: 1030 - RNA, 96 nt, H. sapiens
caagacugggcuccccaccacuuaaacguggauguacuugcuuugaaacuaaagaaguaagugcuuccauguuuuggugaugguaagucuuccuuu

SEQ ID NO: 1031 - RNA, 81 nt, H. sapiens
ugagucuaguuacuaggcaguguaguuagcugauugcuaauaguaccaaucacuaaccacacggccagguaaaaagauuug

SEQ ID NO: 1032 - RNA, 91 nt, H. sapiens
cggcgcuucgcuccccuccgccuucucuucccgguucuucccggagucgggaaaagcuggguugagagggcgaaaaaggaugaggugacug

SEQ ID NO: 1033 - RNA, 81 nt, H. sapiens
auggauaaggcauuggccuccuaagccagggauuguggguucgagucccaucugggguggccugugacuuuuguccuuuuu

SEQ ID NO: 1034 - RNA, 79 nt, H. sapiens
ugcuguggccuauggcuuuucauuccuaugugauugcugucccaaacucauguagggcuaaaagccaugggcuacagug

SEQ ID NO: 1035 - RNA, 75 nt, H. sapiens
uuuccugcccucgaggagcucacagucuaguaugucucauccccuacuagacugaagcuccuugaggacagggau

SEQ ID NO: 1036 - RNA, 91 nt, H. sapiens
uguaccuggugugauuauaaagcaaugagacugauugucauaugucguuugugggauccgucucaguuacuuuauagccauaccugguauc

SEQ ID NO: 1037 - RNA, 82 nt, H. sapiens
uguuuggguuuguucuagguauggucccagggaucccagaucaaaccaggccccugggccuauccuagaaccaaccuaagcu

SEQ ID NO: 1038 - RNA, 82 nt, H. sapiens
gcgggggcccucgucuuacccagcaguguuugggugcgguugggagucucuaauacugccggguaaugauggaggccccugu

SEQ ID NO: 1039 - RNA, 91 nt, H. sapiens
ugcucgguuuguaggcagugucauuagcugauuguacuguggugguuacaaucacuaacuccacugccaucaaaacaaggcacagcaucac

SEQ ID NO: 1040 - RNA, 87 nt, H. sapiens
aggggcgggcggccgcucucccuguccuccaggagcucacgugugccugccugugagcgccucgacgacagagccgcgccugcccca

SEQ ID NO: 1041 - RNA, 89 nt, H. sapiens
aggggcggggcggccgcucucccuguccuccaggagcucacgugugccugccugugagcgccucgacgacagagccggcgccugcccca

SEQ ID NO: 1042 - RNA, 94 nt, H. sapiens
agugcuugguuccuaguagguguccaguaaguguuugugacauaauuuguuuauugaggaccuccuaucaaucaagcacugugcuaggcucugg

SEQ ID NO: 1043 - RNA, 93 nt, H. sapiens
cucaucugucuguugggcuggaggcagggccuuugugaaggcggguggugcucagaucgccucugggcccuuccuccagccccgaggcggauu

SEQ ID NO: 1044 - RNA, 93 nt, H. sapiens; identical to SEQ ID NO: 1043

SEQ ID NO: 1045 - RNA, 87 nt, H. sapiens
ugguaccugaagagagguuuucuggguuucuguuucuuuaaugaggacgaaacacaccugguuaaccucuuuuccaguaucaaaucc

SEQ ID NO: 1046 - RNA, 87 nt, H. sapiens
ugguaccugaagagagguuuucuggguuucuguuucuuuauugaggacgaaacacaccugguuaaccucuuuuccaguaucaaaucc

SEQ ID NO: 1047 - RNA, 92 nt, H. sapiens
cuuuggcgaucacugccucucugggccugugucuuaggcucugcaagaucaaccgagcaaagcacacggccugcagagaggcagcgcucugc

SEQ ID NO: 1048 - RNA, 93 nt, H. sapiens
guagucaguaguuggggggugggaacggcuucauacaggaguugaugcacaguuauccagcuccuauaugaugccuuucuucauccccuucaa

SEQ ID NO: 1049 - RNA, 72 nt, H. sapiens
cugcugacuccuaguccagggcucgugauggcuggugggcccugaacgaggggucuggaggccuggguuuga

SEQ ID NO: 1050 - RNA, 96 nt, H. sapiens
ucuguguugggcgucugucugcccgcaugccugccucucuguugcucugaaggaggcaggggcugggccugcagcugccugggcagagcggcuccu

SEQ ID NO: 1051 - RNA, 109 nt, H. sapiens
ggucgggcucaccaugacacagugugagaccucgggcuacaacacaggacccgggcgcugcucugaccccucgugucuuguguugcagccggagggacgcagguccgca

SEQ ID NO: 1052 - RNA, 67 nt, H. sapiens
cccuccggugccuacugagcugauaucaguucucauuuuacacacuggcucaguucagcaggaacag

SEQ ID NO: 1053 - RNA, 95 nt, H. sapiens
ugguauacaggaaaaugaccuaugaauugacagacaauauagcugaguuugucugucauuucuuuaggccaauauucuguaugacugugcuacuu

SEQ ID NO: 1054-1058 - skipped (5 entries)

SEQ ID NO: 1059 - RNA, 21 nt, H. sapiens
uucacaguggcuaaguucugc

SEQ ID NO: 1060 - RNA, 21 nt, H. sapiens
uguuauaguauuccaccuacc

SEQ ID NO: 1061 - RNA, 21 nt, H. sapiens
ugcuaaucgugauagggguuu

SEQ ID NO: 1062 - RNA, 22 nt, H. sapiens
uuaaugcuaaucgugauagggg

SEQ ID NO: 1063 - RNA, 21 nt, H. sapiens
agacauguucagcuuugugga

SEQ ID NO: 1064 - RNA, 21 nt, H. sapiens
agccuguggagcugcgcuuac

SEQ ID NO: 1065 - RNA, 22 nt, H. sapiens
uaccacaggguagaaccacgga

SEQ ID NO: 1066 - RNA, 24 nt, H. sapiens
uaccacaggguagaaccacggaca

SEQ ID NO: 1067 - RNA, 23 nt, H. sapiens
uggcagugucuuagcugguuguu

SEQ ID NO: 1068 - RNA, 21 nt, H. sapiens
ugaaauguuuaggaccacuag

SEQ ID NO: 1069 - RNA, 22 nt, H. sapiens
ugaaauguuuaggaccacuaga

SEQ ID NO: 1070 - RNA, 22 nt, H. sapiens
caacaaaucacagucugccaua

SEQ ID NO: 1071 - RNA, 22 nt, H. sapiens
cccuguagaaccgaauuugugu

SEQ ID NO: 1072 - RNA, 23 nt, H. sapiens
uacccuguagaaccgaauuugug

SEQ ID NO: 1073 - RNA, 21 nt, H. sapiens
ucacagugaaccggucucuuu

SEQ ID NO: 1074 - RNA, 21 nt, H. sapiens
uaucaaacauauuccuacagu

SEQ ID NO: 1075 - RNA, 22 nt, H. sapiens
ugauauguuugauauauuaggu

SEQ ID NO: 1076 - RNA, 21 nt, H. sapiens
ucguaccgugaguaauaaugc

SEQ ID NO: 1077 - RNA, 22 nt, H. sapiens
uaacagucuacagccauggucg

SEQ ID NO: 1078 - RNA, 22 nt, H. sapiens
ugagguaguaguuugugcuguu

SEQ ID NO: 1079 - RNA, 21 nt, H. sapiens
ugggcaagaggacuuuuuaau

SEQ ID NO: 1080 - RNA, 22 nt, H. sapiens
uaaagcuagauaaccgaaagua

SEQ ID NO: 1081 - RNA, 23 nt, H. sapiens
ucuuugguuaucuagcuguauga

SEQ ID NO: 1082 - RNA, 23 nt, H. sapiens
ugagguaguagguugugugguuu

SEQ ID NO: 1083 - RNA, 21 nt, H. sapiens
uggaauguaaagaaguaugua

SEQ ID NO: 1084 - RNA, 22 nt, H. sapiens
uggagugugacaaugguguuug

SEQ ID NO: 1085 - RNA, 21 nt, H. sapiens
ugacaucacauauacggcagc

SEQ ID NO: 1086 - RNA, 22 nt, H. sapiens
uguaguguuuccuacuuuaugg

SEQ ID NO: 1087 - RNA, 23 nt, H. sapiens
uguaguguuuccuacuuuaugga

SEQ ID NO: 1088 - RNA, 21 nt, H. sapiens
ugagaugaagcacuguagcuc

SEQ ID NO: 1089 - RNA, 18 nt, H. sapiens
cugaccuaugaauugaca

SEQ ID NO: 1090 - RNA, 22 nt, H. sapiens
ugaccuaugaauugacagccag

SEQ ID NO: 1091 - RNA, 21 nt, H. sapiens
uaagacuugcagugauguuua

SEQ ID NO: 1092 - RNA, 21 nt, H. sapiens
ugucaacaaaacugcuuacaa

SEQ ID NO: 1093 - RNA, 21 nt, H. sapiens
uaccaguuguuuucucuguga

SEQ ID NO: 1094 - RNA, 21 nt, H. sapiens
ugacaggaaaucuuugagagg

SEQ ID NO: 1095 - RNA, 21 nt, H. sapiens
uuccacucuguuuaucugaca

SEQ ID NO: 1096 - RNA, 22 nt, H. sapiens
aacauucaacgcugucggugag

SEQ ID NO: 1097 - RNA, 21 nt, H. sapiens
uagguaguuucauguuguugg

SEQ ID NO: 1098 - RNA, 21 nt, H. sapiens
ugagguaguagauuguauagu

SEQ ID NO: 1099 - RNA, 21 nt, H. sapiens
uugcaugcccuauugauucuc

SEQ ID NO: 1100 - RNA, 22 nt, H. sapiens
uagcaccauuugaaaucgguua

SEQ ID NO: 1101 - RNA, 22 nt, H. sapiens
cagugcaauguuaaaagggcau

SEQ ID NO: 1102 - RNA, 21 nt, H. sapiens
ugucagaugcuuaauguucuu

SEQ ID NO: 1103 - RNA, 22 nt, H. sapiens
uugugcuugaucuaaccaugug

SEQ ID NO: 1104 - RNA, 21 nt, H. sapiens
uaaggcacgcggugaaugcca

SEQ ID NO: 1105 - RNA, 23 nt, H. sapiens
uuaaggcacgcggugaaugccaa

SEQ ID NO: 1106 - RNA, 22 nt, H. sapiens
agcuacauugucugcuggguuu

SEQ ID NO: 1107 - RNA, 23 nt, H. sapiens
agcuacaucuggcuacugggucu

SEQ ID NO: 1108 - RNA, 24 nt, H. sapiens
uguaaacauccccgacuggaagcu

SEQ ID NO: 1109 - RNA, 21 nt, H. sapiens
ucacauuugccugcagagauu

SEQ ID NO: 1110 - RNA, 22 nt, H. sapiens
aagcccuuaccccaaaaagcau

SEQ ID NO: 1111 - RNA, 22 nt, H. sapiens
cuuuuugcggucugggcuugcu

SEQ ID NO: 1112 - RNA, 21 nt, H. sapiens
ugguuaaaauauuaauggggc

SEQ ID NO: 1113 - RNA, 22 nt, H. sapiens
agagguaguagguugcauaguu

SEQ ID NO: 1114 - RNA, 22 nt, H. sapiens
cuauacgaccugcugccuuucu

SEQ ID NO: 1115 - RNA, 21 nt, H. sapiens
uagcagcacaucaugguuuac

SEQ ID NO: 1116 - RNA, 22 nt, H. sapiens
uagcaccaucugaaaucgguua

SEQ ID NO: 1117 - RNA, 19 nt, H. sapiens
ugauauguuugauauuggg

SEQ ID NO: 1118 - RNA, 22 nt, H. sapiens
uacaguagucugcacauugguu

SEQ ID NO: 1119 - RNA, 21 nt, H. sapiens
uuacauggggaagcuaucaua

SEQ ID NO: 1120 - RNA, 23 nt, H. sapiens
ugagguaguagguuguaugguuu

SEQ ID NO: 1121 - RNA, 23 nt, H. sapiens
uucccuuugucauccuaugccug

SEQ ID NO: 1122 - RNA, 21 nt, H. sapiens
guccaguuuucccaggaaucc

SEQ ID NO: 1123 - RNA, 21 nt, H. sapiens
ugugauuuccaauaauugagg

SEQ ID NO: 1124 - RNA, 21 nt, H. sapiens
uaggccaaauggcgcaucaau

SEQ ID NO: 1125 - RNA, 21 nt, H. sapiens
acugcauuaugagcacuuaaa

SEQ ID NO: 1126 - RNA, 22 nt, H. sapiens
uaaagugcuuauagugcaggua

SEQ ID NO: 1127 - RNA, 23 nt, H. sapiens
agcugguguugugaaucaggccg

SEQ ID NO: 1128 - RNA, 22 nt, H. sapiens
cccaguguucagacuaccuguu

SEQ ID NO: 1129 - RNA, 24 nt, H. sapiens
uguaaacauccuacacucucagcu

SEQ ID NO: 1130 - RNA, 21 nt, H. sapiens
ugacagucaauuaacaaguuu

SEQ ID NO: 1131 - RNA, 22 nt, H. sapiens
agagguauagggcaugggaaaa

SEQ ID NO: 1132 - RNA, 21 nt, H. sapiens
uuccuaugcauauacuucuuu

SEQ ID NO: 1133 - RNA, 21 nt, H. sapiens
ugacaguuuauuggcuuuauc

SEQ ID NO: 1134 - RNA, 23 nt, H. sapiens
uggaauguaaagaaguauguauu

SEQ ID NO: 1135 - RNA, 21 nt, H. sapiens
uuccuccuccuccgacucgga

SEQ ID NO: 1136 - RNA, 22 nt, H. sapiens
uucccuuugucauccuucgccu

SEQ ID NO: 1137 - RNA, 22 nt, H. sapiens
uguaaacauccuacacucagcu

SEQ ID NO: 1138 - RNA, 21 nt, H. sapiens
uuacagcaauccaguaaugau

SEQ ID NO: 1139 - RNA, 22 nt, H. sapiens
uacccuguagauccgaauuugu

SEQ ID NO: 1140 - RNA, 22 nt, H. sapiens
cagugcaaugaugaaagggcau

SEQ ID NO: 1141 - RNA, 21 nt, H. sapiens
uaaacuggcugauaauuuuug

SEQ ID NO: 1142 - RNA, 21 nt, H. sapiens
ugcaaguaugaaaaugagauu

SEQ ID NO: 1143 - RNA, 21 nt, H. sapiens
ugacgcugcuccccaccuucu

SEQ ID NO: 1144 - RNA, 21 nt, H. sapiens
ugcaauuugcuugcaauuuug

SEQ ID NO: 1145 - RNA, 21 nt, H. sapiens
ugcaagcagaugcugauaaua

SEQ ID NO: 1146 - RNA, 21 nt, H. sapiens
uuaaaguggauguguguuauu

SEQ ID NO: 1147 - RNA, 21 nt, H. sapiens
uucaaguaauucaggauaggu

SEQ ID NO: 1148 - RNA, 21 nt, H. sapiens
ugcuuucccuccuuccuucuu

SEQ ID NO: 1149 - RNA, 23 nt, H. sapiens
uauggcuuuuuauuccuauguga

SEQ ID NO: 1150 - RNA, 21 nt, H. sapiens
uggccauaaacuuguagucau

SEQ ID NO: 1151 - RNA, 21 nt, H. sapiens
uagcagcacauaaugguuugu

SEQ ID NO: 1152 - RNA, 22 nt, H. sapiens
ugagguaguaguuuguacaguu

SEQ ID NO: 1153 - RNA, 21 nt, H. sapiens
ugcaaggauuuuuauguuuug

SEQ ID NO: 1154 - RNA, 21 nt, H. sapiens
uuccaguugcagcaccuguaa

SEQ ID NO: 1155 - RNA, 21 nt, H. sapiens
agccaggugccuucaccugcu

SEQ ID NO: 1156 - RNA, 21 nt, H. sapiens
uggcagcucuggcauuucaua

SEQ ID NO: 1157 - RNA, 21 nt, H. sapiens
ugaucuugcucuaacacuugg

SEQ ID NO: 1158 - RNA, 21 nt, H. sapiens
ugacaaguauguuuuaucguu

SEQ ID NO: 1159 - RNA, 20 nt, H. sapiens
uccaacugcaagaaguuacu

SEQ ID NO: 1160 - RNA, 21 nt, H. sapiens
uaguacgagaagaaggaggcu

SEQ ID NO: 1161 - RNA, 21 nt, H. sapiens
ugguucuagacuugccaacua

SEQ ID NO: 1162 - RNA, 21 nt, H. sapiens
ucuccuucaaccaccugaggu

SEQ ID NO: 1163 - RNA, 21 nt, H. sapiens
uaggaguuugauaugacauau

SEQ ID NO: 1164 - RNA, 21 nt, H. sapiens
agacaaacaugcuacucucac

SEQ ID NO: 1165 - RNA, 21 nt, H. sapiens
uagccuaucuccgaaccuuca

SEQ ID NO: 1166 - RNA, 21 nt, H. sapiens
ugaaaggcacuuuguccaauu

SEQ ID NO: 1167 - RNA, 21 nt, H. sapiens
ucaccugcucuggaaguaguu

SEQ ID NO: 1168 - RNA, 21 nt, H. sapiens
ugauggccagcugagcagcuc

SEQ ID NO: 1169 - RNA, 21 nt, H. sapiens
uggugaggggaaugaaaagua

SEQ ID NO: 1170 - RNA, 22 nt, H. sapiens
uacaguacugugauaacugaag

SEQ ID NO: 1171 - skipped

SEQ ID NO: 1172 - RNA, 20 nt, H. sapiens
uagcaccauuugaaaucagu

SEQ ID NO: 1173 - RNA, 22 nt, H. sapiens
uagcaccauuugaaaucagugu

SEQ ID NO: 1174-1175 - skipped (2 entries)

SEQ ID NO: 1176 - RNA, 23 nt, H. sapiens
uagcagcacguaaauauuggcgu

SEQ ID NO: 1177 - RNA, 23 nt, H. sapiens
uaaggugcaucuagugcagauag

SEQ ID NO: 1178 - skipped

SEQ ID NO: 1179 - RNA, 23 nt, H. sapiens
aguuuugcagguuugcauccagc

SEQ ID NO: 1180 - RNA, 20 nt, H. sapiens
acugcagugaaggcacuugu

SEQ ID NO: 1181 - RNA, 23 nt, H. sapiens
caaagugcuuacagugcagguag

SEQ ID NO: 1182 - RNA, 21 nt, H. sapiens
uauugcacuugucccggccug

SEQ ID NO: 1183 - RNA, 23 nt, H. sapiens
uuuggcacuagcacauuuuugcu

SEQ ID NO: 1184 - RNA, 23 nt, H. sapiens
uguaaacauccucgacuggaagc

SEQ ID NO: 1185 - RNA, 20 nt, H. sapiens
ucaaaugcucagacuccugu

SEQ ID NO: 1186 - RNA, 19 nt, H. sapiens
uucacaguggcuaaguucc

SEQ ID NO: 1187 - RNA, 21 nt, H. sapiens
uucacaguggcuaaguuccgc

SEQ ID NO: 1188 - RNA, 22 nt, H. sapiens
uucacaguggcuaaguuccgcc

SEQ ID NO: 1189 - RNA, 22 nt, H. sapiens
aaagugcuguucgugcagguag

SEQ ID NO: 1190 - RNA, 17 nt, H. sapiens
caaagugcuguucgugc

SEQ ID NO: 1191 - RNA, 23 nt, H. sapiens
caaagugcuguucgugcagguag

SEQ ID NO: 1192 - RNA, 22 nt, H. sapiens
uucaacggguauuuauugagca

SEQ ID NO: 1193 - RNA, 22 nt, H. sapiens
aacccguagauccgaucuugug

SEQ ID NO: 1194 - RNA, 20 nt, H. sapiens
acccguagauccgaucuugu

SEQ ID NO: 1195 - RNA, 22 nt, H. sapiens
cauugcacuugucucggucuga

SEQ ID NO: 1196 - RNA, 22 nt, H. sapiens
aaggagcucacagucuauugag

SEQ ID NO: 1197 - RNA, 22 nt, H. sapiens
aggcaagaugcuggcauagcug

SEQ ID NO: 1198 - RNA, 21 nt, H. sapiens
ggcaagaugcuggcauagcug

SEQ ID NO: 1199 - RNA, 21 nt, H. sapiens
uauugcacauuacuaaguugc

SEQ ID NO: 1200 - RNA, 22 nt, H. sapiens
ucuggcuccgugucuucacucc

SEQ ID NO: 1201 - RNA, 22 nt, H. sapiens
cacccguagaaccgaccuugcg

SEQ ID NO: 1202 - RNA, 23 nt, H. sapiens
ucccugagacccuuuaaccugug

SEQ ID NO: 1203 - RNA, 21 nt, H. sapiens
uucaaguaauccaggauaggc

SEQ ID NO: 1204 - RNA, 20 nt, H. sapiens
ucggauccgucugagcuugg

SEQ ID NO: 1205 - RNA, 22 nt, H. sapiens
ucggauccgucugagcuuggcu

SEQ ID NO: 1206 - RNA, 23 nt, H. sapiens
acuccauuuguuuugaugaugga

SEQ ID NO: 1207 - RNA, 22 nt, H. sapiens
uagguuauccguguugccuucg

SEQ ID NO: 1208 - RNA, 23 nt, H. sapiens
caaagaauucuccuuuugggcuu

SEQ ID NO: 1209 - RNA, 19 nt, H. sapiens
gguccagaggggagauagg

SEQ ID NO: 1210 - RNA, 22 nt, H. sapiens
caacggaaucccaaaagcagcu

SEQ ID NO: 1211 - RNA, 24 nt, H. sapiens
caacggaaucccaaaagcagcugu

SEQ ID NO: 1212 - RNA, 22 nt, H. sapiens
uggaauguaaggaagugugugg

SEQ ID NO: 1213 - RNA, 20 nt, H. sapiens
aaagugcugacagugcagau

SEQ ID NO: 1214 - RNA, 21 nt, H. sapiens
uaaagugcugacagugcagau

SEQ ID NO: 1215 - RNA, 22 nt, H. sapiens
uggacggagaacugauaagggu

SEQ ID NO: 1216 - RNA, 21 nt, H. sapiens
uagcagcacagaaauauuggc

SEQ ID NO: 1217 - RNA, 21 nt, H. sapiens
aacuggccuacaaagucccag

SEQ ID NO: 1218 - RNA, 18 nt, H. sapiens
uggagagaaaggcaguuc

SEQ ID NO: 1219 - RNA, 22 nt, H. sapiens
caucccuugcaugguggagggu

SEQ ID NO: 1220 - RNA, 22 nt, H. sapiens
uucaccaccuucuccacccagc

SEQ ID NO: 1221 - RNA, 22 nt, H. sapiens
uguaacagcaacuccaugugga

SEQ ID NO: 1222 - RNA, 22 nt, H. sapiens
auaagacgagcaaaaagcuugu

SEQ ID NO: 1223 - RNA, 18 nt, H. sapiens
ucuacagugcacgugucu

SEQ ID NO: 1224 - RNA, 24 nt, H. sapiens
cucuaauacugccugguaaugaug

SEQ ID NO: 1225 - RNA, 22 nt, H. sapiens
uaauacugccugguaaugauga

SEQ ID NO: 1226 - RNA, 23 nt, H. sapiens
uaauacugccugguaaugaugac

SEQ ID NO: 1227 - RNA, 21 nt, H. sapiens
uaacacugucugguaacgaug

SEQ ID NO: 1228 - RNA, 22 nt, H. sapiens
uaacacugucugguaacgaugu

SEQ ID NO: 1229 - RNA, 23 nt, H. sapiens
ucaagagcaauaacgaaaaaugu

SEQ ID NO: 1230 - RNA, 22 nt, H. sapiens
cuggcccucucugcccuuccgu

SEQ ID NO: 1231 - RNA, 20 nt, H. sapiens
acugccccaggugcugcugg

SEQ ID NO: 1232 - RNA, 22 nt, H. sapiens
ccacugccccaggugcugcugg

SEQ ID NO: 1233 - RNA, 23 nt, H. sapiens
cgcauccccuagggcauuggugu

SEQ ID NO: 1234 - RNA, 23 nt, H. sapiens
uccagcaucagugauuuuguuga

SEQ ID NO: 1235 - RNA, 22 nt, H. sapiens
gcacauuacacggucgaccucu

SEQ ID NO: 1236 - RNA, 24 nt, H. sapiens
ucucacacagaaaucgcacccguc

SEQ ID NO: 1237 - RNA, 21 nt, H. sapiens
uccugucagacuuuguucggu

SEQ ID NO: 1238 - RNA, 20 nt, H. sapiens
guguguggaaaugcuucugc

SEQ ID NO: 1239 - RNA, 23 nt, H. sapiens
caagucacuagugguuccguuua

SEQ ID NO: 1240 - RNA, 21 nt, H. sapiens
ugugacugguugaccagaggg

SEQ ID NO: 1241 - RNA, 22 nt, H. sapiens
ugagaacugaauuccauggguu

SEQ ID NO: 1242 - RNA, 22 nt, H. sapiens
ucucccaacccuuguaccagug

SEQ ID NO: 1243 - RNA, 20 nt, H. sapiens
uguaaacauccuugacugga

SEQ ID NO: 1244 - RNA, 22 nt, H. sapiens
uguaaacauccuugacuggaag

SEQ ID NO: 1245 - RNA, 21 nt, H. sapiens
agggcccccccucaauccugu

SEQ ID NO: 1246 - RNA, 22 nt, H. sapiens
ugguuuaccgucccacauacau

SEQ ID NO: 1247 - RNA, 23 nt, H. sapiens
cagugcaauaguauugucaaagc

SEQ ID NO: 1248 - RNA, 25 nt, H. sapiens
cagugcaauaguauugucaaagcau

SEQ ID NO: 1249 - RNA, 23 nt, H. sapiens
uaagugcuuccauguuuugguga

SEQ ID NO: 1250 - RNA, 22 nt, H. sapiens
aggcaguguaguuagcugauug

SEQ ID NO: 1251 - RNA, 23 nt, H. sapiens
aggcaguguaguuagcugauugc

SEQ ID NO: 1252 - RNA, 23 nt, H. sapiens
aaaagcuggguugagagggcgaa

SEQ ID NO: 1253 - RNA, 21 nt, H. sapiens
uaagccagggauuguggguuc

SEQ ID NO: 1254 - RNA, 22 nt, H. sapiens
uauggcuuuucauuccuaugug

SEQ ID NO: 1255 - RNA, 22 nt, H. sapiens
acuagacugaagcuccuugagg

SEQ ID NO: 1256 - RNA, 22 nt, H. sapiens
ucgaggagcucacagucuagua

SEQ ID NO: 1257 - RNA, 23 nt, H. sapiens
uccgucucaguuacuuuauagcc

SEQ ID NO: 1258 - RNA, 21 nt, H. sapiens
gccccugggccuauccuagaa

SEQ ID NO: 1259 - RNA, 22 nt, H. sapiens
aauacugccggguaaugaugga

SEQ ID NO: 1260 - RNA, 22 nt, H. sapiens
aggcagugucauuagcugauug

SEQ ID NO: 1261 - RNA, 21 nt, H. sapiens
ucccuguccuccaggagcuca

SEQ ID NO: 1262 - RNA, 23 nt, H. sapiens
ccuaguagguguccaguaagugu

SEQ ID NO: 1263 - RNA, 20 nt, H. sapiens
ccucugggcccuuccuccag

SEQ ID NO: 1264 - RNA, 21 nt, H. sapiens
ccucugggcccuuccuccagc

SEQ ID NO: 1265 - RNA, 22 nt, H. sapiens
aacacaccugguuaaccucuuu

SEQ ID NO: 1266 - RNA, 23 nt, H. sapiens
gcaaagcacacggccugcagaga

SEQ ID NO: 1267 - RNA, 23 nt, H. sapiens
uccagcuccuauaugaugccuuu

SEQ ID NO: 1268 - RNA, 21 nt, H. sapiens
ugcugacuccuaguccagggc

SEQ ID NO: 1269 - RNA, 23 nt, H. sapiens
ugucugcccgcaugccugccucu

SEQ ID NO: 1270 - RNA, 21 nt, H. sapiens
ucgugucuuguguugcagccg

SEQ ID NO: 1271 - RNA, 23 nt, H. sapiens
gugccuacugagcugauaucagu

SEQ ID NO: 1272 - RNA, 21 nt, H. sapiens
aggcagauagagaagucacag

SEQ ID NO: 1273 - RNA, 83 nt, Mouse
gcccgggacccaguucaaguaauucaggauagguuguggugcugaccagccuguucuccauuacuuggcucgggggccggugc

SEQ ID NO: 1274 - RNA, 86 nt, Mouse
gacagugagcgacuguaaacauccucgacuggaagcugugaagccacaaaugggcuuucagucggauguuugcagcugccuacugc

SEQ ID NO: 1275 - RNA, 85 nt, Mouse
gagugacagauauuguaaacauccuacacucucagcugugaaaaguaagaaagcugggagaaggcuguuuacucucucugccuug

SEQ ID NO: 1276 - RNA, 84 nt, Mouse
ccugagcuguuggauucggggccguagcacugucugagagguuuacauuucucacagugaaccggucucuuuuucagcugcuuc

SEQ ID NO: 1277 - RNA, 92 nt, Mouse
cucuucuucuggaagcugguuucacaugguggcuuagauuuuuccaucuuuguaucuagcaccauuugaaaucaguguuuuaggaguaagaa

SEQ ID NO: 1278 - RNA, 63 nt, Mouse
ggcugaccgauuucuccugguguucagagucuguuuuugucuagcaccauuugaaaucgguua

SEQ ID NO: 1279 - RNA, 81 nt, Mouse
cggugacagcacauuauuacuuuugguacgcgcugugacacuucaaacucguaccgugaguaauaaugcgcggucagcagc

SEQ ID NO: 1280 - RNA, 141 nt, Mouse
gggugaggaggcgggccggcaugccuuugcugcuggccggagcucuuuucacauugugcuacugucuaacguguaccgagcagugcaauguuaaaagggcaucggccuuguaguacuacccagugccggcagccuccucag

SEQ ID NO: 1281 - RNA, 87 nt, Mouse
uaccugcuugggacacauacuucuuuauaugcccauaugaaccugcuaagcuauggaauguaaagaaguauguauuucaggcuagga

SEQ ID NO: 1282 - RNA, 86 nt, Mouse
ugagggccccucugcguguucacagcggaccuugauuuaaugucuauacaauuaaggcacgcggugaaugccaagagaggcgccuc

SEQ ID NO: 1283 - RNA, 86 nt, Mouse
aaugcuuugcugaagcugguaaaauggaaccaaaucagcuguuggauggauuugguccccuucaaccagcuguagcugcgcauuga

SEQ ID NO: 1284 - RNA, 79 nt, Mouse
acucugcucuccguguucacagcggaccuugauuuaaugucauacaauuaaggcacgcggugaaugccaagagcggagc

SEQ ID NO: 1285 - RNA, 91 nt, Mouse
gcgggguugguuguuaucuuugguuaucuagcuguaugagugguguggagucuucauaaagcuagauaaccgaaaguaaaaauaaccccau

SEQ ID NO: 1286 - RNA, 85 nt, Mouse
ccuuaaaguacuguagcagcacaucaugguuuacauacuacagucaagaugcgaaucauuauuugcugcucuagaaauuuaagga

SEQ ID NO: 1287 - RNA, 83 nt, Mouse
uuguuccacucuagcagcacguaaauauuggcguagugaaauaaauauuaaacaccaauauuauugugcugcuuuagugugac

SEQ ID NO: 1288 - RNA, 84 nt, Mouse
gacucucuucggugacggguauucuuggguggauaauacggauuacguuguuauugcuuaagaauacgcguagucgaggagagu

SEQ ID NO: 1289 - RNA, 83 nt, Mouse
caggcugcccuggcucaguuaucacagugcugaugcuguccauucuaaagguacaguacugugauaacugaaggauggcagcc

SEQ ID NO: 1290 - skipped

SEQ ID NO: 1291 - RNA, 71 nt, Mouse
aggaugacugauuucuuuugguguucagagucaauagaauuuucuagcaccaucugaaaucgguuauaaug

SEQ ID NO: 1292 - RNA, 66 nt, Mouse
aagcugguuucauauggugguuuagauuuaaauagugauugucuagcaccauuugaaaucaguguu

SEQ ID NO: 1293 - RNA, 72 nt, Mouse
ugagacaaaguucugagacacuccgacucugaguaugauagaagucagugcacuacagaacuuugucucuag

SEQ ID NO: 1294 - RNA, 94 nt, Mouse
uggcuggcucuggguccaucuuccagugcaguguuggaugguugaaguaugaagcuccuaacacugucugguaaagauggcccccgggucaguu

SEQ ID NO: 1295 - RNA, 95 nt, Mouse
aaugggaggcccguuucucucuuugguuaucuagcuguaugagugccacagagccgucauaaagcuagauaaccgaaaguagaaaugacucucac

SEQ ID NO: 1296 - RNA, 76 nt, Mouse
ucggacggcugggguuccuggggaugggauuugaugccagucacaaaucacauugccagggauuuccaacugaccc

SEQ ID NO: 1297 - RNA, 111 nt, Mouse
ucugccucucuccgggcuccgccucccgugccuacugagcugaaacaguugauuccagugcacuggcucaguucagcaggaacaggaguccagcccccuaggagcuggcaa

SEQ ID NO: 1298 - RNA, 83 nt, Mouse
ucuguguccugccagugguuuuacccuaugguagguuacgucaugcuguucuaccacaggguagaaccacggacaggguacug

SEQ ID NO: 1299 - RNA, 81 nt, Mouse
uucccagguugagguaguagguuguauaguuuagaguuacaucaagggagauaacuguacagccuccuagcuuuccuuggg

SEQ ID NO: 1300 - RNA, 81 nt, Mouse
gcuccccucagucccugagacccuaacuugugauguuuaccguuuaaauccacggguuaggcucuugggagcugcgggucg

SEQ ID NO: 1301 - RNA, 94 nt, Mouse
gaaggccguggccucguucaaguaauccaggauaggcugugcaggucccaaggggccuauucuugguuacuugcacggggacgcgggccuggac

SEQ ID NO: 1302 - RNA, 107 nt, Mouse
cacaccauggcccuggcugagguaguaguuugugcuguuggucggguugugacauugcccgcuguggagauaacugcgcaagcuacugccuugcuagugcuggugau

SEQ ID NO: 1303 - RNA, 94 nt, Mouse
gcuguaccaccuugucggauagcuuaucagacugauguugacuguugaaucucauggcaacagcagucgaugggcugucugacauuuugguauc

SEQ ID NO: 1304 - RNA, 86 nt, Mouse
ggcugagccgcaguaguucuucaguggcaagcuuuauguccugacccagcuaaagcugccaguugaagaacuguugcccucugccc

SEQ ID NO: 1305 - RNA, 88 nt, Mouse
agacagugcagucacccauaaaguagaaagcacuacuaacagcacuggaggguguaguguuuccuacuuuauggaugagugcacugug

SEQ ID NO: 1306 - RNA, 78 nt, Mouse
gaccuuggcugggauaucaucauauacuguaaguuugugaugagacacuacaguauagaugauguacuagucugggua

SEQ ID NO: 1307 - RNA, 74 nt, Mouse
ccgggccuagguucugugauacacuccgacucgggcucuggagcagucagugcaugacagaacuugggcccggu

SEQ ID NO: 1308 - RNA, 91 nt, Mouse
acuuagcgguggccggugucauuuuugugacguugcagcuaguaauaugagcccaguugcauagucacaaaagugaucauuggaaacugug

SEQ ID NO: 1309 - RNA, 101 nt, Mouse
ucucuucacugugggaugagguaguagguuguauaguuuuagggucacacccaccacugggagauaacuauacaaucuacugucuuuccuaaggugaugga

SEQ ID NO: 1310 - RNA, 107 nt, Mouse
aaaauggguuccuaggaagagguaguagguugcauaguuuuagggcagagauuuugcccacaaggaguuaacuauacgaccugcugccuuucuuagggccuuauuau

SEQ ID NO: 1311 - RNA, 106 nt, Mouse
acuugcucuaucagagugagguaguagauuguauaguugugggguagugauuuuacccuguuuaggagauaacuauacaaucuauugccuucccugaggaguagac

SEQ ID NO: 1312 - RNA, 96 nt, Mouse
ucaccugcucuggcugcuuggguuccuggcaugcugauuugugacuugagauuaaaaucacauugccagggauuaccacgcaaccaugaccuuggc

SEQ ID NO: 1313 - RNA, 81 nt, Mouse
gacccgcccuccggugccuacugagcugauaucaguucucauuucacacacuggcucaguucagcaggaacaggagucgag

SEQ ID NO: 1314 - RNA, 96 nt, Mouse
ccucucuaacaaggugcagagcuuagcugauuggugaacagugauugguuuccgcuuuguucacaguggcuaaguucugcaccugaagagaaggug

SEQ ID NO: 1315 - RNA, 108 nt, Mouse
ccuugugagggaagcgaguuguuaucuuugguuaucuagcuguaugaguguauuggucuucauaaagcuagauaaccgaaaguaaaaacuccuucaaggucaccgagg

SEQ ID NO: 1316 - RNA, 70 nt, Mouse
aaguagcagcacauaaugguuuguggauguugaaaaggugcaggccauacugugcugccucaaaauacaa

SEQ ID NO: 1317 - RNA, 70 nt, Mouse
ccuuagcagcacguaaauauuggcguuaagauucugaaauuaccuccaguauugacugugcugcugaagu

SEQ ID NO: 1318 - RNA, 83 nt, Mouse
aggccucucucuccguguucacagcggaccuugauuuaaauguccauacaauuaaggcacgcggugaaugccaagaauggggc

SEQ ID NO: 1319 - RNA, 81 nt, Mouse
gcuuuuuguucuaaggugcaucuagugcagauagugaaguagacuagcaucuacugcccuaagugcuccuucuggcauaag

SEQ ID NO: 1320 - RNA, 90 nt, Mouse
ugacagcuucuguagcacuaaagugcuuauagugcagguaguguguagccaucuacugcauuacgagcacuuaaaguacugccagcugua

SEQ ID NO: 1321 - RNA, 101 nt, Mouse
ucuaagccaaguuucaguucauguaaacauccuacacucagcugucauacaugcguuggcugggauguggauguuuacgucagcugucuuggaguauccac

SEQ ID NO: 1322 - RNA, 103 nt, Mouse
ugcugucagaaagucugugucuguaaacauccccgacuggaagcuguaagccacagccaagcuuucagucagauguuugcugcuacuggcucuucgaaugcau

SEQ ID NO: 1323 - RNA, 100 nt, Mouse
gacaccgcagggugagguaguagguugugugguuucagggcagugauguugccccuccgaagauaacuauacaaccuacugccuucccugaggcgcccag

SEQ ID NO: 1324 - RNA, 86 nt, Mouse
ggccuuuggggugagguaguagguuguaugguuuugggcucugccccgcucugcgguaacuauacaaucuacugucuuuccugaag

SEQ ID NO: 1325 - RNA, 101 nt, Mouse
aagcugugugcauccggguugagguaguagguuguaugguuuagaguuacacccugggaguuaacuguacaaccuucuagcuuuccuuggagcacacuuga

SEQ ID NO: 1326 - RNA, 88 nt, Mouse
augcccauugacauaaacccguagauccgaucuuguggugaaguggaccgcgcaagcucguuucuaugggucuguggcagugugguga

SEQ ID NO: 1327 - RNA, 94 nt, Mouse
ugaaggcuguaugcuguuaaugcuaauugugauagggguuuuggccucugacugacuccuaccuguuagcauuaacaggacacaaggccuguua

SEQ ID NO: 1328 - RNA, 96 nt, Mouse
gccgcgccccccgggcugagguaggagguuguauaguugaggaagacacccgaggagaucacuauacggccuccuagcuuuccccaggcugcgccc

SEQ ID NO: 1329 - RNA, 146 nt, Mouse
guuuucacagcuaucggccggcgcaggagugccuacucagagcacauacuucuuuauguacccauaugaacauucagugcuauggaauguaaagaaguauguauuuuggguagguaauguccgccaagaagaagcuaaaggaaacu

SEQ ID NO: 1330 - RNA, 89 nt, Mouse
gcaaugcuuugcuaaagcugguaaaauggaaccaaaucgccucuucaauggauuugguccccuucaaccagcuguagcuaugcauugau

SEQ ID NO: 1331 - RNA, 113 nt, Mouse
ccugcgugcggagcgccugucucccagccugaggugcagugcugcaucucuggucaguugggagucugagaugaagcacuguagcucaggaagggagaagauguccugcagcc

SEQ ID NO: 1332 - RNA, 81 nt, Mouse
uuguccucacgguccaguuuucccaggaaucccuuggaugcuaagauggggauuccuggaaauacuguucuugaggucaug

SEQ ID NO: 1333 - RNA, 81 nt, Mouse
uuccuuagcagagcuguggagugugacaaugguguuuguguccaaaccaucaaacgccauuaucacacuaaauagcuacug

SEQ ID NO: 1334 - RNA, 119 nt, Mouse
cagcgcaaggacauugcuacuuacgauuaguuuugcagauuugcaguucagcguauaugugaauauauggcugugcaaauccaugcaaaacugauugugggaauguguaccuuucugca

SEQ ID NO: 1335 - RNA, 101 nt, Mouse
cuggugcucugugggaugagguaguagauuguauaguuuuagggucauaccccaucuuggagauaacuauacagucuacugucuuucccacggugguacac

SEQ ID NO: 1336 - RNA, 103 nt, Mouse
cuacuguggaggcugcggcuggauucaaguaauccaggauaggcuguguccguccaugaggccuguucuugauuacuuguuucuggaggcagcgcauggucug

SEQ ID NO: 1337 - RNA, 98 nt, Mouse
uuugaucacugucuccagccugcugaagcucagagggcucugauucagaaagaucaucggauccgucugagcuuggcuggucggaagucucaucaucu

SEQ ID NO: 1338 - RNA, 80 nt, Mouse
gagcccucggaggacuccauuuguuuugaugauggauucuuaagcuccaucaucgucucaaaugagucuucagaggguuc

SEQ ID NO: 1339 - RNA, 83 nt, Mouse
cggugcuugaagauagguuauccguguugccuucgcuuuauucgugacgaaucauacacgguugaccuauuuuucaguaccaa

SEQ ID NO: 1340 - RNA, 85 nt, Mouse
ccagugcccaggcucuggcuccgugucuucacucccguguuuguccgaggagggagggagggacgggggcggugcuggggcaacu

SEQ ID NO: 1341 - RNA, 91 nt, Mouse
accauguuguaguguguguaaacauccuacacucucagcugugagcucaagguggcugggagaggguuguuuacuccuucugccauggaaa

SEQ ID NO: 1342 - RNA, 81 nt, Mouse
guccuggcacccacccguagaaccgaccuugcggggccuucgccgcacacaagcucgugucuguggguccgugucgggggc

SEQ ID NO: 1343 - RNA, 122 nt, Mouse
ccggccucugggucccugagacccuuuaaccugugaggacguccagggucacaggugagguucuugggagccuggcgccuggcccagccacaaauuuagggauuucaggugaccccuggcaa

SEQ ID NO: 1344 - RNA, 81 nt, Mouse
acuuugccuagucccugagacccuaacuugugagguauuuuaguaacaucacaagucagguucuugggaccuaggcggagg

SEQ ID NO: 1345 - RNA, 100 nt, Mouse
ugaacauccaggucuggggcaugaaccuggcauacaauguagauuucuguguuuguuaggcaacagcuacauugucugcuggguuucaggcuaccuggaa

SEQ ID NO: 1346 - RNA, 82 nt, Mouse
gguccagugguucuugacaguucaacaguucuguagcacaauugugaaauguuuaggaccacuagacccggcgcgcacggcg

SEQ ID NO: 1347 - RNA, 104 nt, Mouse
uuugccugauuccaggcugagguaguaguuuguacaguuugagggucuaugauaccacccgguacaggagauaacuguacaggccacugccuugccaggaacag

SEQ ID NO: 1348 - RNA, 97 nt, Mouse
aucugagacugaacugcccuuuuucgguuaucaugguaccgaugcuguagcucugaaagguacaguacugugauagcugaagaauggcggugccauc

SEQ ID NO: 1349 - RNA, 65 nt, Mouse
augucaaagugcuaacagugcagguagcuuuuugaguucuacugcagugccagcacuucuuacau

SEQ ID NO: 1350 - RNA, 84 nt, Mouse
gucagaauaaugucaaagugcuuacagugcagguagugaugugugcaucuacugcagugagggcacuuguagcauuaugcugac

SEQ ID NO: 1351 - RNA, 110 nt, Mouse
ccagaggauaccuccacuccgucuacccaguguuuagacuaccuguucaggacucccaaauuguacaguagucugcacauugguuaggcugggcuggguuagacccucgg

SEQ ID NO: 1352 - RNA, 72 nt, Mouse
guuccuuuuuccuaugcauauacuucuuuguggaucuggucuaaagagguauagcgcaugggaagauggagc

SEQ ID NO: 1353 - RNA, 106 nt, Mouse
cugcuuggaccugugaccugugggcuucccuuugucauccuuugccuaggccucugagugaggcaaggacagcaaaggggggcucaguggucaccucuacugcaga

SEQ ID NO: 1354 - RNA, 108 nt, Mouse
aaacauagucauuacaguuuuugauguugcagauacugcaucaggaacugacuggauaagacuuaauccccaucaguuccuaaugcauugccuucagcaucuaaacaa

SEQ ID NO: 1355 - RNA, 82 nt, Mouse
gggcuuuuaagucacuagugguuccguuuaguagaugguuugugcauuguuucaaaauggugcccuagugacuacaaagccc

SEQ ID NO: 1356 - RNA, 111 nt, Mouse
aggagcggaguacgugagccagugcuauguggaagacuugugauuuuguuguucugauaugauaugacaacaagucacagccagccucauagcguggacuccuaucaccuu

SEQ ID NO: 1357 - RNA, 98 nt, Mouse
auauagugcuugguuccuaguaggugcucaguaaguguuugugacauaauucguuuauugagcaccuccuaucaaucaagcacugugcuaggcucugg

SEQ ID NO: 1358 - RNA, 95 nt, Mouse
cucaucugucuguugggcugggggcagggccuuugugaaggcggguuaugcucagaucgccucugggcccuuccuccagucccgaggcagauuua

SEQ ID NO: 1359 - RNA, 97 nt, Mouse
uguucgcuucugguaccggaagagagguuuucugggucucuguuucuuugaugagaaugaaacacacccagcuaaccuuuuuuucaguaucaaaucc

SEQ ID NO: 1360 - RNA, 98 nt, Mouse
gacccuuuggcgaucucugccucucugggccugugucuuaggcucuucaagauccaacgagcaaagcacagggccugcagagagguagcgcucugcuc

SEQ ID NO: 1361 - RNA, 97 nt, Mouse
caguguagugagaaguuggggggugggaacggcgucaugcaggaguugauugcacagccauucagcuccuauaugaugccuuucuucacccccuuca

SEQ ID NO: 1362 - RNA, 96 nt, Mouse
acccaaguccaggccugcugaccccuaguccagugcuugugguggcuacugggcccugaacuaggggucuggagaccuggguuugaucuccacagg

SEQ ID NO: 1363 - RNA, 98 nt, Mouse
ucuguguugggcgucugucugcccgagugccugccucucuguugcucugaaggaggcaggggcugggccugcagcugccugggcagagcugcuccuuc

SEQ ID NO: 1364 - RNA, 95 nt, Mouse
agcgcuuuccugcccucgaggagcucacagucuaguaugucuccucccuacuagacugaggcuccuugaggacagggaucgucauacucaccucc

SEQ ID NO: 1365 - RNA, 84 nt, Mouse
gugcucgguuuguaggcaguguaauuagcugauuguagugcggugcugacaaucacuaacuccacugccaucaaaacaaggcac

SEQ ID NO: 1366 - RNA, 110 nt, Mouse
ugguguggcaaccccuaaaggcucagcauuaagguggguggaauaauauaacaauauccguguuguuauaguauuccaccuacccugaugcauuuuguugucguuuucuu

SEQ ID NO: 1367 - RNA, 110 nt, Mouse
ggccagcugugaguaauucuuuggcagugucuuagcugguuguugugaguauuagcuaaggaagcaaucagcaaguauacugcccuagaagugcugcacauuguugggcc

SEQ ID NO: 1368 - RNA, 99 nt, Mouse
uuggauguuggccuaguucuguguggaagacuagugauuuuguuguuuuuagauaacuaaaacgacaacaaaucacagucugccauauggcacaggcca

SEQ ID NO: 1369 - RNA, 107 nt, Mouse
gagguuguaacguugucuauauauacccuguagaaccgaauuugugugguacccacauagucacagauucgauucuaggggaauauauggucgaugcaaaaacuuca

SEQ ID NO: 1370 - RNA, 102 nt, Mouse
gccccgcccccgcgucuccagggcaaccguggcuuucgauuguuacugugggaaccggagguaacagucuacagccauggucgccccgcagcacgcccacgc

SEQ ID NO: 1371 - RNA, 103 nt, Mouse
ccgaugcacacugcaagaacaauaaggauuuuuaggggcauuaugacugagucaggaaacacagcugccccugaaagucccucauuuuucuugcuguccuuga

SEQ ID NO: 1372 - RNA, 103 nt, Mouse
ccccgcccgggcagcgcgccggcaccuuggcucuagacugcuuacugcccgggccgccuucaguaacagucuccagucacggccaccgacgccuggccccgcc

SEQ ID NO: 1373 - RNA, 107 nt, Mouse
ccccuuauaggcucguuuugacaggaaaucuuugagaggcagcggcagugaggugcccagagauuucaucucucuuuugcuuuaggaaaugcugagcauaaggcucc

SEQ ID NO: 1374 - RNA, 96 nt, Mouse
cagacaauccauggguccucuuguccuucauuccaccggagucugucuuaugccaaccagauuucaguggagugaagcucaggaggcauggagcug

SEQ ID NO: 1375 - RNA, 94 nt, Mouse
accuccuggcgggcagcuguggugcauuguaguugcauugcauguucuggcaauaccugugcaauguuuccacagugcaucacggaggccugcc

SEQ ID NO: 1376 - RNA, 110 nt, Mouse
ugcuugcucagcugaucuguggcuuagguaguuucauguuguugggauugaguuuugaacucggcaacaagaaacugccugaguuacaucagucgguuuucgucgagggc

SEQ ID NO: 1377 - RNA, 110 nt, Mouse
uugaacaugaugaaugauuggagucagagaagcggcgugauagauggcagcaccuuggcuccauugcaugcccuauugauucuccuucuuuauuacuccuacaacccagc

SEQ ID NO: 1378 - RNA, 100 nt, Mouse
uaucaucuugucagaugcuuaauguucuuccuccugucacuuuggauaggcccaauuuguagaauacugcacggguaaaggaugacaauuaacagugaca

SEQ ID NO: 1379 - RNA, 110 nt, Mouse
gugauaauggagcgagauuuucuguugugcuugaucuaaccaugugcuugcgagguaugagaaaaacaugguuccgucaagcaccauggaacgucacgcagcuuucuaca

SEQ ID NO: 1380 - RNA, 90 nt, Mouse
cccucaguggcucaguagccaguguagauccugucuuugguaaucagcagcuacaucuggcuacugggucucugguggcaucaucuagcu

SEQ ID NO: 1381 - RNA, 106 nt, Mouse
cccggcagccacugugcagugggaaggggggccgaugcacuguaagagagugaguagcaggucucacagugaaccggucucuuucccuacugugucaaacuccuaa

SEQ ID NO: 1382 - RNA, 107 nt, Mouse
gggcccugaacucaggggcuucgccacugauuguccaaacgcaauucuuguacgagucugcggccaaccgagaauuguggcuggacaucugugguugagcuccgggc

SEQ ID NO: 1383 - RNA, 96 nt, Mouse
gaugcuugauguugucagacugaagaaucucuacagguaagugugugguuucuucagugacaucacauuugccugcagagauuucccagucugcca

SEQ ID NO: 1384 - RNA, 97 nt, Mouse
cugccuuucgcgaaucuuuuugcggucugggcuugcuguacauaacucaauagccggaagcccuuaccccaaaaagcauucgcggagggcgcgcucg

SEQ ID NO: 1385 - RNA, 87 nt, Mouse
gcccccugcucuggcuggucaaacggaaccaaguccgucuuccugagagguuugguccccuucaaccagcuacagcagggcuggcaa

SEQ ID NO: 1386 - RNA, 82 nt, Mouse
ccugccugcuucugugugauauguuugauauuggguuguuaaauuaugaaccaacugaaugucaagcauacucucacagcag

SEQ ID NO: 1387 - RNA, 110 nt, Mouse
ggcuacaguccuucuucaugugacucguggacuucccuuugucauccuaugccugagaauauaugaaggaggcugggaaggcaaagggacguucaauugucaucacuggc

SEQ ID NO: 1388 - RNA, 101 nt, Mouse
agguugcuucagugaacauucaacgcugucggugaguuuggaauucaaauaaaaaccaucgaccguugauuguacccuauagcuaaccaucaucuacucca

SEQ ID NO: 1389 - RNA, 111 nt, Mouse
cagcgauacauuaaugcucaucuggcucugcaaaucuuaccguuugcuuaggccaaauggcgcaucaaugacuaucgcucuuuacaaaacucuugaaucaguguuauguaa

SEQ ID NO: 1390 - RNA, 104 nt, Mouse
uucugguaugguugcugcagcugguguugugaaucaggccgacgagcagcgcauccucuuacccggcuauuucacgacaccaggguugcacccuacccauccuc

SEQ ID NO: 1391 - RNA, 97 nt, Mouse
uggagcugcugagugaauuagguaguuucauguuguugggccuggauuucugaacacaacgacauuaaaccacccgacucacggcagcuacugcucc

SEQ ID NO: 1392 - RNA, 103 nt, Mouse
ggaagcuucaggagauccugcuccgucgccccaguguucagacuaccuguucaggacaaugccguuguacaguagucugcacauugguuagacugggcaaggg

SEQ ID NO: 1393 - RNA, 88 nt, Mouse
aaaggucacaaucaacauucauugcugucgguggguugaacuguguagaaaagcucacugaacaaugaaugcaacuguggccccgcuu

SEQ ID NO: 1394 - RNA, 110 nt, Mouse
guauauucaaggacaggccauugacagucaauuaacaaguuugauugguaugucaacucauucuuuugaauuguuaauaguauguuaauagcauucguuucuuugugcag

SEQ ID NO: 1395 - RNA, 109 nt, Mouse
cucuggccuccgcuuccuccuccuccgacucggacgccggcggagccuccccgcccccgcgaaagaagccccgagccucggcggcggagggagcaggagagcccggggc

SEQ ID NO: 1396 - RNA, 110 nt, Mouse
gaccaguugccgcggggcuuuccuuugugcuugaucuaaccaugugguggaacgauggaaacggaacaugguucugucaagcaccgcggaaagcaucgcucucuccugca

SEQ ID NO: 1397 - RNA, 93 nt, Mouse
uuagcauuugaggugaaguucuguuauacacucaggcuguggcucugaaagucagugcaucacagaacuuugucucgaaagcuuucuagcagc

SEQ ID NO: 1398 - RNA, 99 nt, Mouse
gauggcuaugaguugguuuaaucucagcuggcaacugugagaugucccuaucauuccucacaguggucucugggauuaugcuaaacagagcaauuuccu

SEQ ID NO: 1399 - RNA, 110 nt, Mouse
guucaacauaagcaaacagauuguaaacuggcugauaauuuuuguacugacaaugucauuuacagcugucagccuuucgucugucuuguuugcuuuauucaaauaugaac

SEQ ID NO: 1400 - RNA, 110 nt, Mouse
cccuccaaugucugauuaaucaagccugcaaacagcuuauuucuuuuugccugcaugcaaguaugaaaaugagauucugggagccgaacauugugcagauuuguucauuc

SEQ ID NO: 1401 - RNA, 103 nt, Mouse
ggcagucccuccaggcucaggacagccacugcccaccgcacacugcguugcuccggacccacugugcgugugacagcggcugaucugucccugggcagcgcga

SEQ ID NO: 1402 - RNA, 94 nt, Mouse
cugcagugucacgcuccguguauuugacaagcugaguuggacacucugugugguagagugucaguuugucaaauaccccaaguguggcucaugc

SEQ ID NO: 1403 - RNA, 109 nt, Mouse
uguugaaugcaagcagaugcugauaauaucagaagucacagcauaauuuuuuugaucaaagggcucaagugagccugaugaagcaugcaucuugcucgucuuugauaaa

SEQ ID NO: 1404 - RNA, 110 nt, Mouse
ccugcagugaugcuucaugagcaaaucacaugaugucagaaugguaugguuucgauuuaaucaagaaagagauuaaaguggauguguguuauuuucaacuucgccgcagc

SEQ ID NO: 1405 - RNA, 87 nt, Mouse
gccccaggccucacuguucucuauggcuuuuuauuccuaugugauucuauugcucgcucauauagggauuggagccguggcguacgg

SEQ ID NO: 1406 - RNA, 110 nt, Mouse
accaagauaaauucacucuagugcuuuauggcuuuuuauuccuaugugaucguaauaaagucucauguagggauggaagccaugaaauacauugugaaaauucaucaacu

SEQ ID NO: 1407 - RNA, 110 nt, Mouse
gaauguaugaucuugcucuaacacuuggccagaccugugucacccaccgcuagugccugaagucgacagacaauucugccaagguaacugagaaucauuaagcauccugc

SEQ ID NO: 1408 - RNA, 95 nt, Mouse
aaugccagcgaguuugaaaggcacuuuguccaauuagaaguguggggaaaauauccauccugucugugacaaagaugaagcacuucuuucaaaag

SEQ ID NO: 1409 - RNA, 109 nt, Mouse
ugugcaccucaccugcucuggaaguaguuugcuagcucugaugcuucaugguucagacuccucaggugcacgauuaaauuuccagaguuggugaacauggcgccacaug

SEQ ID NO: 1410 - RNA, 98 nt, Mouse
uugccaaggguuugggggaacauucaaccugucggugaguuugggcagcucagacaaaccaucgaccguugaguggaccccgaggccuggaacugcca

SEQ ID NO: 1411 - RNA, 80 nt, Mouse
ccuguugccacaaacccguagauccgaacuugugcugauucugcacacaagcuugugucuauagguaugugucuguuagg

SEQ ID NO: 1412 - RNA, 81 nt, Mouse
cucugugcuuucagcuucuuuacaguguugccuuguggcauggaguucaagcagcauuguacagggcuaucaaagcacaga

SEQ ID NO: 1413 - RNA, 76 nt, Mouse
ccucuguuaguuuugcauaguugcacuacaagaagaauguaguugugcaaaucuaugcaaaacugaugguggccug

SEQ ID NO: 1414 - RNA, 77 nt, Mouse
ucuaugguuaguuuugcagguuugcauccagcuguauaauauucugcugugcaaauccaugcaaaacugacuguggu

SEQ ID NO: 1415 - RNA, 80 nt, Mouse
cuuucuacacagguugggauuugucgcaaugcuguguuucucuguaugguauugcacuugucccggccuguugaguuugg

SEQ ID NO: 1416 - RNA, 80 nt, Mouse
gugagguaguaaguuguauuguugugggguagggauuuuaggccccaguaagaagauaacuauacaacuuacuacuuucc

SEQ ID NO: 1417 - RNA, 78 nt, Mouse
aaaugucagacagcccaucgacugcuguugccaugagauucaacagucaacaucagucugauaagcuauccgacaagg

SEQ ID NO: 1418 - RNA, 77 nt, Mouse
ccugaggagcagggcuuagcugcuugugagcaagguccacagcaaagucguguucacaguggcuaaguuccgccccc

SEQ ID NO: 1419 - RNA, 103 nt, Mouse
cuccuguaacucggaacuggagaggaggcaagaugcuggcauagcuguugaacugagaaccugcuaugccaacauauugccaucuuuccugucugacagcagc

SEQ ID NO: 1420 - RNA, 100 nt, Mouse
ucugcuugcucugguggagauauugcacauuacuaaguugcauguugucacggccucaaugcaauuuagugugugugauauuuucacaugagugcaugca

SEQ ID NO: 1421 - RNA, 88 nt, Mouse
auugcuuacaacuuuccaaagaauucuccuuuugggcuuucucauuuuauuuuaagcccuaaggugaauuuuuugggaaguuugagcu

SEQ ID NO: 1422 - RNA, 100 nt, Mouse
ccaauggcuggacagcgggcaacggaaucccaaaagcagcuguugucuccagagcauuccagcugcacuuggauuucguucccugcucuccugccugagc

SEQ ID NO: 1423 - RNA, 81 nt, Mouse
ccuggcucuagcagcacagaaauauuggcauggggaagugagucugccaauauuggcugugcugcuccaggcaggguggug

SEQ ID NO: 1424 - RNA, 80 nt, Mouse
gggagcugagagcugggucuuugcgggcaagaugagagugucaguucaacuggccuacaaagucccaguccucggucccc

SEQ ID NO: 1425 - RNA, 89 nt, Mouse
ucccugcucccucucucacaucccuugcaugguggagggugagcucucugaaaaccccucccacaugcaggguuugcaggauggugagc

SEQ ID NO: 1426 - RNA, 83 nt, Mouse
uuccuuugacgggugagcuuuuggcccggguuauaccugacacucacguauaagacgagcaaaaagcuuguuggucagaggag

SEQ ID NO: 1427 - RNA, 97 nt, Mouse
ggacaggcgcagguguauucuacagugcacgugucuccaguguggcucggaggcuggagacgcggcccuguuggaguaacaacugaagccagagucu

SEQ ID NO: 1428 - RNA, 71 nt, Mouse
guggccaucuuacugggcagcauuggauagugucugaucucuaauacugccugguaaugaugacggcggag

SEQ ID NO: 1429 - RNA, 86 nt, Mouse
gggccucugugggcaucuuaccggacagugcuggauuucuuggcuugacucuaacacugucugguaacgauguucaaaggugaccc

SEQ ID NO: 1430 - RNA, 83 nt, Mouse
ugacuaugccuccucgcauccccuagggcauugguguaaagcuggagacccacugccccaggugcugcuggggguuguagucu

SEQ ID NO: 1431 - RNA, 82 nt, Mouse
guccuccccaacaauauccuggugcugagugggugcacagugacuccagcaucagugauuuuguugaagagggcagcugcca

SEQ ID NO: 1432 - RNA, 82 nt, Mouse
ugguacuuggagagaggugguccguggcgcguucgcuucauuuauggcgcacauuacacggucgaccucuuugcgguaucua

SEQ ID NO: 1433 - RNA, 94 nt, Mouse
gaaaaugggcucaaggugaggggugcuaucugugauugagggacauggucaauggaauugucucacacagaaaucgcacccgucaccuuggccu

SEQ ID NO: 1434 - RNA, 81 nt, Mouse
augguguugugggacagcugguguugugaaucaggccguugccaaucagagaacggcuacuucacaacaccagggccacac

SEQ ID NO: 1435 - RNA, 84 nt, Mouse
auggcugcacucaacauucauugcugucgguggguuugaaugucaaccaacucacugaucaaugaaugcaaacugcgggccaaa

SEQ ID NO: 1436 - RNA, 76 nt, Mouse
gugcuuucagcuucuuuacagugcugccuuguagcauucaggucaagcagcauuguacagggcuaugaaagaacca

SEQ ID NO: 1437 - RNA, 73 nt, Mouse
cagggugugugacugguugaccagaggggcgugcacucuguucacccugugggccaccuagucaccaacccuc

SEQ ID NO: 1438 - RNA, 93 nt, Mouse
uguguauccccagcucugagaacugaauuccauggguuauaucaaugucagaccugugaaauucaguucuucagcugggauagcucugucauc

SEQ ID NO: 1439 - RNA, 94 nt, Mouse
ugggcagucuuugcuacuguaaacauccuugacuggaagcuguaagguguugagaggagcuuucagucggauguuuacagcggcaggcugccac

SEQ ID NO: 1440 - RNA, 79 nt, Mouse
cgguacuugaagaaaugguuuaccgucccacauacauuuugaguauguaugugggacgguaaaccgcuucuugguaucc

SEQ ID NO: 1441 - RNA, 91 nt, Mouse
uguacuuggugugauuauaaagcaaugagacugauugucauaugucguuugugggauccgucucaguuacuuuauagccauaccugguauc

SEQ ID NO: 1442 - RNA, 79 nt, Mouse
uguuuggguuuguucuagguauggucccagggaucccagaucaaaccaggccccugggccuauccuagaaccaaccuaa

SEQ ID NO: 1443 - RNA, 76 nt, Mouse
ccucaggcuacaacacaggacccgggcgcugcucugaccccucgugucuuguguugcagccggagggacgcagguc

SEQ ID NO: 1444 - RNA, 66 nt, Mouse
uaccuuacucaguaaggcauuguucuucuauauuaauaaaugaacagugccuuucuguguagggua

SEQ ID NO: 1445 - RNA, 79 nt, Mouse
aaggcaggggugaggggcugcgggaggagccgggcggaggcugcggcuugcgcuucuccuggcucuccucccucucuuu

SEQ ID NO: 1446 - RNA, 82 nt, Mouse
ccuauguagcggccaucaaaguggaggcccucucuugagccugaaugagaaagugcuuccacuuugugugccacugcauggg

SEQ ID NO: 1447 - RNA, 82 nt, Mouse
cagccugugauacucaaacugggggcucuuuuggauuuucaucggaagaaaagugccgccagguuuugagugucaccgguug

SEQ ID NO: 1448 - RNA, 80 nt, Mouse
uucaaucugugguacucaaacugugugacauuuuguucuuuguaagaagugccgcagaguuuguaguguugccgauugag

SEQ ID NO: 1449 - RNA, 84 nt, Mouse
uuccauauagccauacucaaaauggaggcccuaucuaagcuuuuaaguggaaagugcuucccuuuuguguguugccauguggag

SEQ ID NO: 1450 - RNA, 69 nt, Mouse
ggugagacucaaauguggggcacacuucuggacuguacauagaaagugcuacuacuuuugagucucucc

SEQ ID NO: 1451 - RNA, 79 nt, Mouse
gcuacuugaagagagguuauccuuuguguguuugcuuuacgcgaaaugaauaugcaagggcaagcucucuucgaggagc

SEQ ID NO: 1452 - RNA, 95 nt, Mouse
ccucguugacuccgaagggcugcagcagcaauucauguuuuggaguauugccaagguucaaaacaugaagcgcugcaacaccccuucguggggaa

SEQ ID NO: 1453 - RNA, 95 nt, Mouse
cugcagccaggguuuuuaccagucaggcuccuggcuagauuccagguaccagcugguaccugaucuagccaaagccugacuguaagcccugaaca

SEQ ID NO: 1454 - RNA, 99 nt, Mouse
agaugccuugcuccuacaagaguaaagugcaugcgcuuugggacagugaggaaaauaauguucacaaagcccauacacuuucacccuuuaggagaguug

SEQ ID NO: 1455 - RNA, 83 nt, Mouse
cucaucuugcgguacucaaacuaugggggcacuuuuuuuuuucuuuaaaaagugccgccuaguuuuaagccccgccgguugag

SEQ ID NO: 1456 - RNA, 99 nt, Mouse
cauggcaccuccguuucccugaggagcccuuugagccuggagugaaaaaaaaaaacaggucaagaggcgccugggaacuggagaagaguguuaaacuuc

SEQ ID NO: 1457 - RNA, 96 nt, Mouse
aaaaugaugaugucaguuggccggucggccgaucgcucggucugucagucagucggucggucgaucggucggucggucagucggcuuccugucuuc

SEQ ID NO: 1458 - RNA, 82 nt, Mouse
ccaggccuuuggcagaggagggcuguucuucccuugaguuuuaugacugggaggaacuagccuucucucagcuuaggagugg

SEQ ID NO: 1459 - RNA, 22 nt, Mouse
uuaaugcuaauugugauagggg

SEQ ID NO: 1460 - RNA, 22 nt, Mouse
uacaguacugugauagcugaag

SEQ ID NO: 1461 - RNA, 22 nt, Mouse
caaagugcuaacagugcaggua

SEQ ID NO: 1462 - RNA, 20 nt, Mouse
acugcagugagggcacuugu

SEQ ID NO: 1463 - RNA, 23 nt, Mouse
cccaguguuuagacuaccuguuc

SEQ ID NO: 1464 - RNA, 22 nt, Mouse
agagguauagcgcaugggaaga

SEQ ID NO: 1465 - RNA, 22 nt, Mouse
uucccuuugucauccuuugccu

SEQ ID NO: 1466 - RNA, 24 nt, Mouse
uacugcaucaggaacugacuggau

SEQ ID NO: 1467 - RNA, 23 nt, Mouse
uaagucacuagugguuccguuua

SEQ ID NO: 1468 - RNA, 21 nt, Mouse
uggaagacuugugauuuuguu

SEQ ID NO: 1469 - RNA, 23 nt, Mouse
ccuaguaggugcucaguaagugu

SEQ ID NO: 1470 - RNA, 21 nt, Mouse
ccucugggcccuuccuccagu

SEQ ID NO: 1471 - RNA, 22 nt, Mouse
aacacacccagcuaaccuuuuu

SEQ ID NO: 1472 - RNA, 23 nt, Mouse
gcaaagcacagggccugcagaga

SEQ ID NO: 1473 - RNA, 23 nt, Mouse
uucagcuccuauaugaugccuuu

SEQ ID NO: 1474 - RNA, 21 nt, Mouse
ugcugaccccuaguccagugc

SEQ ID NO: 1475 - RNA, 23 nt, Mouse
ugucugcccgagugccugccucu

SEQ ID NO: 1476 - RNA, 22 nt, Mouse
acuagacugaggcuccuugagg

SEQ ID NO: 1477 - RNA, 21 nt, Mouse
cuagacugaggcuccuugagg

SEQ ID NO: 1478 - RNA, 23 nt, Mouse
uaggcaguguaauuagcugauug

SEQ ID NO: 1479 - RNA, 21 nt, Mouse
uacucaguaaggcauuguucu

SEQ ID NO: 1480 - RNA, 23 nt, Mouse
gcuucuccuggcucuccucccuc

SEQ ID NO: 1481 - RNA, 23 nt, Mouse
aaagugcuuccacuuugugugcc

SEQ ID NO: 1482 - RNA, 22 nt, Mouse
caucaaaguggaggcccucucu

SEQ ID NO: 1483 - RNA, 23 nt, Mouse
aagugccgccagguuuugagugu

SEQ ID NO: 1484 - RNA, 22 nt, Mouse
acucaaacugggggcucuuuug

SEQ ID NO: 1485 - RNA, 22 nt, Mouse
agugccgcagaguuuguagugu

SEQ ID NO: 1486 - RNA, 22 nt, Mouse
aaagugcuucccuuuugugugu

SEQ ID NO: 1487 - RNA, 23 nt, Mouse
aaagugcuacuacuuuugagucu

SEQ ID NO: 1488 - RNA, 22 nt, Mouse
uaugcaagggcaagcucucuuc

SEQ ID NO: 1489 - RNA, 20 nt, Mouse
aaacaugaagcgcugcaaca

SEQ ID NO: 1490 - RNA, 23 nt, Mouse
ugaucuagccaaagccugacugu

SEQ ID NO: 1491 - RNA, 24 nt, Mouse
uucacaaagcccauacacuuucac

SEQ ID NO: 1492 - RNA, 23 nt, Mouse
cucaaacuaugggggcacuuuuu

SEQ ID NO: 1493 - RNA, 24 nt, Mouse
ucccugaggagcccuuugagccug

SEQ ID NO: 1494 - RNA, 21 nt, Mouse
ucgaucggucggucggucagu

SEQ ID NO: 1495 - RNA, 22 nt, Mouse
ggcagaggagggcuguucuucc

SEQ ID NO: 1496 - RNA, 85 nt, Rat
cagcuucuguagcacuaaagugcuuauagugcagguagugugucgucaucuacugcauuacgagcacuuacaguacugccagcug

SEQ ID NO: 1497 - RNA, 97 nt, Rat
agcgcuuuccugcccucgaggagcucacagucuaguaugucuccucccuacuagacugaggcuccuugaggacagggaucgucauacucaccucccg

SEQ ID NO: 1498 - RNA, 98 nt, Rat
ucuguguugggcaucugucugccugagugccugccucucuguugcucugaaggaggcaggggcugggccugcagcugccugggcagagcugcuccuuc

SEQ ID NO: 1499 - RNA, 113 nt, Rat
ccugagcgcggagcgccugucucccagccugaggugcagugcugcaucucuggucaguugggagucugagaugaagcacuguagcucaggaagggagaagauguucugcagcc

SEQ ID NO: 1500 - RNA, 81 nt, Rat
gguccagugguucuuaacaguucaacaguucuguagcgcaauugugaaauguuuaggaccacuagacccggcgcgcacggc

SEQ ID NO: 1501 - RNA, 83 nt, Rat
gcccgggacccaguucaaguaauucaggauagguuguggugcuggccagccuguucuccauuacuuggcucgggggccggugc

SEQ ID NO: 1502 - RNA, 92 nt, Rat; identical to SEQ ID NO: 1277

SEQ ID NO: 1503 - RNA, 81 nt, Rat
cggugacagcacauuauuacuuuugguacgcgcugugacacuucaaacucguaccgugaguaauaaugcguggucaacagc

SEQ ID NO: 1504 - RNA, 142 nt, Rat
gggugaggaggcgggccggcaugccuuugcugcuggccggagcucuuuucacauugugcuacugucuacacguguaccgagcagugcaauguuaaaagggcaucggccuuguaguacuacccagugccggcagccuccucag

SEQ ID NO: 1505 - RNA, 83 nt, Rat
uuguuccgcucuagcagcacguaaauauuggcguagugaaauaaauauuaaacaccaauauuauugugcugcuuuagugugac

SEQ ID NO: 1506 - RNA, 92 nt, Rat
aaugggaggcccguuucucucuuugguuaucuagcuguaugagugccacagagccgucauaaagcuagauaaccgaaaguagaaaugacucu

SEQ ID NO: 1507 - RNA, 76 nt, Rat
ucggccggcugggguuccuggggaugggauuugaugccagucacaaaucacauugccagggauuuccaacugaccc

SEQ ID NO: 1508 - RNA, 83 nt, Rat
ucuguguccugccagugguuuuacccuaugguagguuacaucaugcuguucuaccacaggguagaaccacggacaggauacug

SEQ ID NO: 1509 - RNA, 81 nt, Rat
gcuccccucagucccugagacccuaacuugugauguuuaccguuuaaauccacggguuaggcucuugggagcugcgagucg

SEQ ID NO: 1510 - RNA, 94 nt, Rat
gaaggccguggccuuguucaaguaauccaggauaggcugugcaggucccaaggggccuauucuugguuacuugcacggggacgcgggccuggac

SEQ ID NO: 1511 - RNA, 94 nt, Rat
gcuguaccaccuugucggguagcuuaucagacugauguugacuguugaaucucauggcaacagcagucgaugggcugucugacauuuugguauc

SEQ ID NO: 1512 - RNA, 85 nt, Rat
ggcugagccgcaguaguucuucaguggcaagcuuuauguccugacccagcuaaagcugccaguugaagaacuguugcccucugcc

SEQ ID NO: 1513 - RNA, 88 nt, Rat
agacagugcagucacccauaaaguagaaagcacuacuaacagcacuggaggguguaguguuuccuacuuuauggaugaguguacugug

SEQ ID NO: 1514 - RNA, 76 nt, Rat
ccuuggcugggauaucaucauauacuguaaguuugugaugagacacuacaguauagaugauguacuagucugggua

SEQ ID NO: 1515 - RNA, 74 nt, Rat
ccgggcccagguucugugauacacuccgacucgggcucuggagcagucagugcaugacagaacuugggcccggu

SEQ ID NO: 1516 - RNA, 91 nt, Rat
acuuagcgguggccagugucauuuuugugauguugcagcuaguaauaugagcccaguugcauagucacaaaagugaucauuggaaacugug

SEQ ID NO: 1517 - RNA, 99 nt, Rat
ucuucacugugggaugagguaguagguuguauaguuuuagggucacacccaccacugggagauaacuauacaaucuacugucuuuccuaaggugaugga

SEQ ID NO: 1518 - RNA, 100 nt, Rat
ugggcuccuaggaagagguaguagguugcauaguuuuagggcagagauuuugcccacaaggaguuaacuauacgaccugcugccuuucuuagggccuuau

SEQ ID NO: 1519 - RNA, 104 nt, Rat
uugcucuaucagagugagguaguagauuguauaguugugggguagugauuuuacccuguuuaggagauaacuauacaaucuauugccuucccugaggaguagac

SEQ ID NO: 1520 - RNA, 97 nt, Rat
uaagccgaguuucaguucauguaaacauccuacacucagcugucauacaugaguuggcugggauguggauguuuacgucagcugucuuggaguaucc

SEQ ID NO: 1521 - RNA, 103 nt, Rat
ugcugucagaaagucugugucuguaaacauccccgacuggaagcuguaagccacagccaagcuuucagucagauguuugcugcuacuggcucuucgcaugcau

SEQ ID NO: 1522 - RNA, 100 nt, Rat
gacaccgcggggugagguaguagguugugugguuucagggcagugaugucgccccuccgaagauaacuauacaaccuacugccuucccugaggcgcccag

SEQ ID NO: 1523 - RNA, 80 nt, Rat
uccuuagcagagcucuggagugugacaaugguguuuguguccaaaacaucaaacgccaucaucacacuaaacagcuacug

SEQ ID NO: 1524 - RNA, 121 nt, Rat
ccggccucugggucccugagacccuuuaaccugugaggacguccagggucacaggugagguucuugggagccuggcgccuggcucagccacaacuuagggauuucaggugaccccuggcaa

SEQ ID NO: 1525 - RNA, 100 nt, Rat
ugaauauccaggucuggggcaugaaccuggcauacaauguagauuucuguguuuguuaggcaacagcuacauugucugcuggguuucaggcuaccuggaa

SEQ ID NO: 1526 - RNA, 97 nt, Rat
aucugagacugaacuguccuuuuucgguuaucaugguaccgaugcuguagaucugaaagguacaguacugugauagcugaagaaugguggugccauc

SEQ ID NO: 1527 - RNA, 84 nt, Rat
gucaggauaaugucaaagugcuuacagugcagguaguggugugugcaucuacugcagugaaggcacuuguggcauugugcugac

SEQ ID NO: 1528 - RNA, 72 nt, Rat
guuccuuuuuccuaugcauauacuucuuuguggaucuggucuaaagagguauagcgcaugggaaaauggagc

SEQ ID NO: 1529 - RNA, 104 nt, Rat
gcuuggaccugugaccucugggcuucccuuugucauccuuugccuaggccucugaguggggcaaggacagcaaaggggggcucaguggucaccucuacugcaga

SEQ ID NO: 1530 - RNA, 89 nt, Rat
uuuugaugucgcagauacugcaucaggaacugacuggauaagacucagucaccaucaguuccuaaugcauugccuucagcaucuaaaca

SEQ ID NO: 1531 - RNA, 97 nt, Rat
ugagccaaugcuauguggaagacuugugauuuuguuguucugauaugauaugacaacaagucacagccagccucauagaguggacucccaucaccuu

SEQ ID NO: 1532 - RNA, 95 nt, Rat
cucaucugucuguggggcugggggcagggccuuugugaaggcggguuaugcucagaucgccucugggcccuuccuccagucccgaggcagauuua

SEQ ID NO: 1533 - RNA, 98 nt, Rat
gacccuuuggcgaucucugccucucugggccugugucuuaggcucuucaagaucuaacgagcaaagcacagggccugcagagagguagcgcucugcuc

SEQ ID NO: 1534 - RNA, 110 nt, Rat
ggccggcugugaguaauucuuuggcagugucuuagcugguuguugugaguauuagcuaaggaagcaaucagcaaguauacugcccuagaagugcugcacguuguuaggcc

SEQ ID NO: 1535 - RNA, 99 nt, Rat
uuggauguuggccuaguucuguguggaagacuagugauuuuguuguuuuuagauaacuaagacgacaacaaaucacagucugccauauggcacaggcca

SEQ ID NO: 1536 - RNA, 104 nt, Rat
guuguaacguugucuauauauacccuguagaaccgaauuugugugguacccacauagucacagauucgauucuaggggaauauauggucgaugcaaaaacuuca

SEQ ID NO: 1537 - RNA, 103 nt, Rat
ccccgcccgggcagcgcgccggcaccuuggcucuagacugcuuacugcccgggccgcccucaguaacagucuccagucacggccaccgacgccuggccccgcc

SEQ ID NO: 1538 - RNA, 100 nt, Rat
ccgaugcacacugcaagaacaauaaggauuuuuaggggcauuaugacugagucaggaaacacagcugccccugaaagucccucauuuuucuugcuguccu

SEQ ID NO: 1539 - RNA, 108 nt, Rat
ccuggauggacagaguugucaugugucugccugucuacacuugcugugcagaacauccgcucaccuguacagcaggcacagacaggcagucacaugacaacccagccu

SEQ ID NO: 1540 - RNA, 109 nt, Rat
ccccuuauaggcucguuuugacaggaaaucuuugagaggcagcggcagugaggugcccagagaguucaucucucucuuuugcuuuaggaaaugcugaguacaaggcucc

SEQ ID NO: 1541 - RNA, 96 nt, Rat
cagacaauccauggguccuccuguccuucauuccaccggagucugucuuaugccaaccagauuucaguggagugaagcucaggaggcauggagcug

SEQ ID NO: 1542 - RNA, 93 nt, Rat
ccuccuggcgggcugccguggugcauuguaguugcauugcauguucuggcaguaccugugcaauguuuccacagugcaucacggaggccugcc

SEQ ID NO: 1543 - RNA, 107 nt, Rat
uugcucagcugaucuguggcuuagguaguuucauguuguugggauugaguuuugaacucggcaacaagaaacugccugaguuacaucagucgguuuucgucgagggc

SEQ ID NO: 1544 - RNA, 110 nt, Rat
gugauaacguagcgagauuuucuguugugcuugaucuaaccaugugcuugcgagguaugaguaaaacaugguuccgucaagcaccauggaacgucacgcagcuuucuaca

SEQ ID NO: 1545 - RNA, 90 nt, Rat
cccucaguggcucaguagccaguguagauccugucuuugguaaucagcagcuacaucuggcuacugggucucugauggcaucaucuagcu

SEQ ID NO: 1546 - RNA, 103 nt, Rat
gcccugaacucaggggcuucaccacugauuguccaaacgcaauucuuguacgagucugcggccaaccgagaauuguggcuggacaucugugguugagcuccgg

SEQ ID NO: 1547 - RNA, 96 nt, Rat
gaugcuugauguugucagacugaagaaucucuacaaguaagugugugauuucuucagugacaucacauuugccugcagagauuucccagucugcca

SEQ ID NO: 1548 - RNA, 97 nt, Rat
cugcccuucgcgaaucuuuuugcggucugggcuugcuguacauaacucaauagccggaagcccuuaccccaaaaagcauucgcggagggcgcgcucg

SEQ ID NO: 1549 - RNA, 110 nt, Rat
ggcuacagcccuucuucaugugacucguggacuucccuuugucauccuaugccugagaauauaugaaggaggcugggaaggcaaagggacguucaauugucaucacuggc

SEQ ID NO: 1550 - RNA, 100 nt, Rat
agguugcuucagugaacauucaacgcugucggugaguuuggaauucaaauaaaaaccaucgaccguugauuguacccuauagcuaaccauuaucuacucc

SEQ ID NO: 1551 - RNA, 110 nt, Rat
cagcgauacauuaaugcucaucuggcucugcaaaucucaccguuugcuuaggccaaauggcgcaucaaugacuaucgcucuuacaaaacucuugaaucaguauuauguaa

SEQ ID NO: 1552 - RNA, 100 nt, Rat
gguaugguugcugcagcugguguugugaaucaggccgacgagcaacgcauccucuuacccggcuauuucacgacaccaggguugcacccuacccauccuc

SEQ ID NO: 1553 - RNA, 103 nt, Rat
ggaagcuucuggagauccugcuccgucgccccaguguucagacuaccuguucaggacaaugccguuguacaguagucugcacauugguuagacugggcaaggg

SEQ ID NO: 1554 - RNA, 110 nt, Rat
guauauucaaggacaggccauugacagucaauuaacaaguuugauugguaugucaacucauucuuuugaauuguuaauaguauguuaauagcguucguuucuuugugcag

SEQ ID NO: 1555 - RNA, 95 nt, Rat
gcuaugaguuaguuuaaucucagcuggcaacugugagaugucccuaucauuccucacaguggucucugggauuaugcuaaacagagcaauuuccu

SEQ ID NO: 1556 - RNA, 110 nt, Rat
cccuccaaugucugauuaaucaagccugcaaacagcuuauuucuuuuugccugcaugcaaguaugaaaaugagauucugggagccgaacacugugcagauuuguucauuc

SEQ ID NO: 1557 - RNA, 103 nt, Rat
ggcagucccuccaggcucaggacagccacugcccacagcacacugcguugcuccggacccacugugcgugugacagcggcugaucugucccugggcagcgcga

SEQ ID NO: 1558 - RNA, 94 nt, Rat
cugcaguguuacgcuccguguauuugacaagcugaguuggacacucugugugguagagugucaguuugucaaauaccccaaguguggcucaugc

SEQ ID NO: 1559 - RNA, 110 nt, Rat
gaauguaugaucuugcucuaacacuuggccagaccugugucacccacugcuagugccugaagucgacagacaauucugccaagguaacugagaaucauuaagcauccugc

SEQ ID NO: 1560 - RNA, 94 nt, Rat
aaugccagcgaguuugaaaggcacuuuguccaauuagaaguguggggagcuauccauccuguccaugaccaagaugaagcacuucuuucaaaag

SEQ ID NO: 1561 - RNA, 80 nt, Rat
ccuguugccacaaacccguagauccgaacuugugcugaccaugcacacaagcuugugucuauagguaugugucuguuagg

SEQ ID NO: 1562 - RNA, 81 nt, Rat
cucucugcuuuaagcuucuuuacaguguugccuuguggcauggaguucaagcagcauuguacagggcuaucaaagcacaga

SEQ ID NO: 1563 - RNA, 76 nt, Rat
ccucuguucguuuugcauaguugcacuacaagaagaauguaguugugcaaaucuaugcaaaacugaugguggccug

SEQ ID NO: 1564 - RNA, 78 nt, Rat
cuuucuacacagguugggauuugucgcaaugcuguguuucuguauaguauugcacuugucccggccuguugaguuugg

SEQ ID NO: 1565 - RNA, 80 nt, Rat
gugagguaguaaguuguauuguugugggguagggauuuuaggccccaauaagaagauaacuauacaacuuacuacuuucc

SEQ ID NO: 1566 - RNA, 78 nt, Rat
aaaugucagacagcccaucgacugcuguugccaugagauucaacagucaacaucagucugauaagcuacccgacaagg

SEQ ID NO: 1567 - RNA, 77 nt, Rat
ccuguggagcagggcuuagcugcuugugagcaaggucuacagcaaagucguguucacaguggcuaaguuccgccccc

SEQ ID NO: 1568 - RNA, 103 nt, Rat
cuccugaaacuuggaacuggagaggaggcaagaugcuggcauagcuguugaacugagaaccugcuaugccaacauauugccaucuuuccugucugacagcagc

SEQ ID NO: 1569 - RNA, 97 nt, Rat
gcuugcucugguggggauauugcacauuacuaaguugcauguugucacggccucaaugcaauuuagugugugugauauucucacaugagugcaugca

SEQ ID NO: 1570 - RNA, 88 nt, Rat
auugcuuacaacuuuccaaagaauucuccuuuugggcuuucucauuuuauuuuaagcccaaaggugaauuuuuugggaaguuugagcu

SEQ ID NO: 1571 - RNA, 100 nt, Rat; identical to SEQ ID NO: 1422

SEQ ID NO: 1572 - RNA, 81 nt, Rat
ccuggcucuagcagcacagaaauauuggcacggguaagugagucugccaauauuggcugugcugcuccaggcaggguggug

SEQ ID NO: 1573 - RNA, 75 nt, Rat
gggagcugagagcugggucuuugcgggcaagaugagggugucaguucaacuggccuacaaagucccaguccucgg

SEQ ID NO: 1574 - RNA, 83 nt, Rat
uuccuuugacgggugagcuuuuggcccggguuauaccugacucucacguauaagacgagcaaaaagcuuguuggucagaggag

SEQ ID NO: 1575 - RNA, 75 nt, Rat
augguguugugggacagcugguguugugaaucaggccguugccaaucagagaacggcuacuucacaacaccaggg

SEQ ID NO: 1576 - RNA, 84 nt, Rat
auggcugcacucaacauucauugcugucgguggguuugaaugucaaccaacucacuggucaaugaaugcaaacugcgggccaaa

SEQ ID NO: 1577 - RNA, 87 nt, Rat
uguguauccucagcucugagaacugaauuccauggguuauagcaaugucagaccugugaaguucaguucuuuagcugggauagcucu

SEQ ID NO: 1578 - RNA, 93 nt, Rat
gggcagucuuugcuacuguaaacauccuugacuggaagcuguaagguguugagaggagcuuucagucggauguuuacagcggcaggcugccac

SEQ ID NO: 1579 - RNA, 77 nt, Rat
ugagucuaguuacuaggcaguguaguuagcugauugcuaauaguaccaaucacuaaccacacagccagguaaaaaga

SEQ ID NO: 1580 - RNA, 79 nt, Rat
ugcuguggccuauggcuuuucauuccuaugugauugcuguuccgaacucauguagggcuaaaagccaugggcuacagug

SEQ ID NO: 1581 - RNA, 111 nt, Rat
cacgcaugagccgaagcuaaccccccaccccagccgcaaagagucuacaugucuagggucuagacauguucagcuuuguggaccuccggcuccugcuccucuuaggggcca

SEQ ID NO: 1582 - RNA, 94 nt, Rat
uuaagcugagugcauugugauuuccaauaauugaggcagugguucuaaaagcugucuacauuaaugaaaagagcaauguggccagcuugacuaa

SEQ ID NO: 1583 - RNA, 110 nt, Rat
cuggaugccuuuucugcaggccucugugugauauguuugauauauuagguuguuauuuaauccaacuauauaucaagcauauuccuacagugucuugcccugucuccggg

SEQ ID NO: 1584 - RNA, 100 nt, Rat
cuugggugggcagcuguuaagacuugcagugauguuuagcuccucuccaugugaacaucacagcaagucugugcugcugccugcccccaugcugccuggg

SEQ ID NO: 1585 - RNA, 110 nt, Rat
cauacacggcuguuacacagguuuucccaugauaaggcgauagguuaaugaaaugcucauuucauuuuaccaguuguuuucucugugaaguuccgauaaguagcaaacca

SEQ ID NO: 1586 - RNA, 110 nt, Rat
cuauaaugcuuagauuaucaaucaucuugacaguuuauuggcuuuaucaccacacauaccauuaaaaugaugucuggcccagacugucaaaagcaaacauuaaacagacc

SEQ ID NO: 1587 - RNA, 106 nt, Rat
cugucugucuucuguauauacccuguagauccgaauuuguguaaggaauuuuguggucacaaauucguaucuaggggaauauguaguugacauaaacacuccgcuc

SEQ ID NO: 1588 - RNA, 71 nt, Rat
gacacucuuucccuguugcacuacugugggccucugggaagcagugcaaugaugaaagggcauccgucagg

SEQ ID NO: 1589 - RNA, 85 nt, Rat
gggaaccagugcuuucaguaagagggugguaccacaugucuucaaaaugaaacgucucuuggagacaaacaugcuacucucacug

SEQ ID NO: 1590 - RNA, 80 nt, Rat
gggggugagggauuggagagaaaggcaguuccugaugguccccucccaggggcuggcuuuccucugguccuucucuccca

SEQ ID NO: 1591 - RNA, 71 nt, Rat
ucccacccccuguaacagcaacuccauguggaagugcccacugauuccaguggggcugcuguuaucugggg

SEQ ID NO: 1592 - RNA, 77 nt, Rat
ggcccugucucccaacccuuguaccagugcugugccucagacccugguacaggccugggggacagggacuuggggac

SEQ ID NO: 1593 - RNA, 77 nt, Rat
uacugcugacgacugcucugacuuuauugcacuacuguacuguacagcuagcagugcaauaguauugucaaagcauc

SEQ ID NO: 1594 - RNA, 67 nt, Rat
ccuccgccuucucuucccgguucuucccggagucgggaaaagcuggguugagagggcgaaaaaggau

SEQ ID NO: 1595 - RNA, 79 nt, Rat
ggggcccucgucuuacccagcaguguuugggugcugguugggagucucuaauacugccggguaaugauggaggccccug

SEQ ID NO: 1596 - RNA, 95 nt, Rat
ccucgcugacuccgaagggaugcagcagcaauucauguuuuggaguauugccaagguucaaaacaugaagcgcugcaacaccccuucgugggaaa

SEQ ID NO: 1597 - RNA, 98 nt, Rat
cugcagccagaguuuuuaccagucaggcuccuggcuagauuccagguaccaacugguaccugaucuagccaaagccugaccguaagcugcaaaagaaa

SEQ ID NO: 1598 - RNA, 99 nt, Rat
agaugccuugcuccuacaagaguaaagugcacgugcuuugggacagugaggaaaauaauguucacaaagcccauacacuuucacccuuuaggagaguug

SEQ ID NO: 1599 - RNA, 81 nt, Rat
cauggcaccuccauuucccugaggagcccuuugagccugaggugaaaaaaaaacaggucaagaggcgccugggaacuggag

SEQ ID NO: 1600 - RNA, 81 nt, Rat
ucaucuugcgguucucaaacuaugggggcacuuuuuuuuucuuuaaaaagugccgccagguuuuagggccugccgguugag

SEQ ID NO: 1601 - RNA, 82 nt, Rat
ccgguguaguagccaucaaaguggaggcccucucuugggcccgagcuagaaagugcuuccacuuugugugccacugcauggg

SEQ ID NO: 1602 - RNA, 82 nt, Rat
caaccugugauacucaaacugggggcucuuuuggguuuucuuuggaagaaaagugccgccagguuuugaguguuaccgauug

SEQ ID NO: 1603 - RNA, 82 nt, Rat
ccaggccuucggcagaggagggcuguucuucccuuggguuuuaugacugggaggaacuagccuucucucugcuuaggagugg

SEQ ID NO: 1604 - RNA, 79 nt, Rat; identical to SEQ ID NO: 1451

SEQ ID NO: 1605 - RNA, 95 nt, Rat
ccccgguggaaccacguggugugcuaguuacuuuugggcuggagagacggcucagggguuaagagcacagacugcucuuccagagguccugaguu

SEQ ID NO: 1606 - RNA, 96 nt, Rat
augugaccgugccucucacccuuccauaucuagucucugagaaaaaugaagacuggauuccaugaagggaugugaggccuggaaacuggagcuuua

SEQ ID NO: 1607 - RNA, 97 nt, Rat
gaagacucuagcauguaagguugggggagggggcugugucuagcaagucuucuucccccacagcccugcugucuuaaccucuagguguuccggcucc

SEQ ID NO: 1608 - RNA, 21 nt, Rat
acugcauuacgagcacuuaca

SEQ ID NO: 1609 - RNA, 23 nt, Rat
ugucugccugagugccugccucu

SEQ ID NO: 1610 - RNA, 23 nt, Rat
ugaucuagccaaagccugaccgu

SEQ ID NO: 1611 - RNA, 20 nt, Rat
guggugugcuaguuacuuuu

SEQ ID NO: 1612 - RNA, 21 nt, Rat
ucacccuuccauaucuagucu

SEQ ID NO: 1613 - RNA, 22 nt, Rat
cagcccugcugucuuaaccucu

SEQ ID NO: 1614 - RNA, 71 nt, Drosophila melanogaster
ggagcgagacggggacucacugugcuuauuaaauagucagucuuuuucucucuccuauacaaauugcgggc

SEQ ID NO: 1615 - RNA, 91 nt, Drosophila melanogaster
aaugauuugacuacgaaaccgguuuucgauuugguuugacuguuuuucauacaagugagaucauuuugaaagcugauuuugucaaugaaua

SEQ ID NO: 1616 - RNA, 21 nt, Drosophila melanogaster
ucagucuuuuucucucuccua

SEQ ID NO: 1617 - RNA, 21 nt, Drosophila melanogaster
gugagaucauuuugaaagcug

SEQ ID NO: 1618 - DNA, 20 bp, Artificial Sequence
  Oligomeric compound
aaaatcacaggaacctatct

SEQ ID NO: 1619 - DNA, 20 bp, Artificial Sequence
  Oligomeric compound
aacggtttatgacaaacatt

SEQ ID NO: 1620 - DNA, 20 bp, Artificial Sequence
  Oligomeric compound
aagagaaggcggaggggagc

SEQ ID NO: 1621 - DNA, 20 bp, Artificial Sequence
  Oligomeric compound
aatgtaacgcatttcaattc

SEQ ID NO: 1622 - DNA, 20 bp, Artificial Sequence
  Oligomeric compound
acaatgcacaaaccatctac

SEQ ID NO: 1623 - DNA, 20 bp, Artificial Sequence
  Oligomeric compound
acaatgcacaatcatctact

SEQ ID NO: 1624 - DNA, 20 bp, Artificial Sequence
  Oligomeric compound
acacttacagtcacaaagct

SEQ ID NO: 1625 - DNA, 20 bp, Artificial Sequence
  Oligomeric compound
acgaattatgtcacaaacac

SEQ ID NO: 1626 - DNA, 20 bp, Artificial Sequence
  Oligomeric compound
acgacttggtgtggaccctg

SEQ ID NO: 1627 - DNA, 20 bp, Artificial Sequence
  Oligomeric compound
actgtccatcttagttcaga

SEQ ID NO: 1628 - DNA, 20 bp, Artificial Sequence
  Oligomeric compound
agacctgactccatccaatg

SEQ ID NO: 1629 - DNA, 20 bp, Artificial Sequence
  Oligomeric compound
agagtcaagctgggaaatcc

SEQ ID NO: 1630 - DNA, 20 bp, Artificial Sequence
  Oligomeric compound
agccaccttgagctcacagc

SEQ ID NO: 1631 - DNA, 20 bp, Artificial Sequence
  Oligomeric compound
agggtctgagcccagcactg

SEQ ID NO: 1632 - DNA, 20 bp, Artificial Sequence
  Oligomeric compound
aggttgggtaatcacactac

SEQ ID NO: 1633 - DNA, 20 bp, Artificial Sequence
  Oligomeric compound
agtaggggatgagacatact

SEQ ID NO: 1634 - DNA, 20 bp, Artificial Sequence
  Oligomeric compound
agttgattcagactcaaacc

SEQ ID NO: 1635 - DNA, 20 bp, Artificial Sequence
  Oligomeric compound
caggttcccagttcaacagc

SEQ ID NO: 1636 - DNA, 20 bp, Artificial Sequence
  Oligomeric compound
cattgaggccgtgacaacat

SEQ ID NO: 1637 - DNA, 20 bp, Artificial Sequence
  Oligomeric compound
ccaagagacgtttcattttg

SEQ ID NO: 1638 - DNA, 20 bp, Artificial Sequence
  Oligomeric compound
ccagcctccgagccacactg

SEQ ID NO: 1639 - DNA, 20 bp, Artificial Sequence
  Oligomeric compound
cccacaaacgacatatgaca

SEQ ID NO: 1640 - DNA, 20 bp, Artificial Sequence
  Oligomeric compound
cctcactcagaggcctaggc

SEQ ID NO: 1641 - DNA, 20 bp, Artificial Sequence
  Oligomeric compound
cctggggaggggaccatcag

SEQ ID NO: 1642 - DNA, 20 bp, Artificial Sequence
  Oligomeric compound
cgtgagcatcaggtataacc

SEQ ID NO: 1643 - DNA, 20 bp, Artificial Sequence
  Oligomeric compound
ctcgaacccacaatccctgg

SEQ ID NO: 1644 - DNA, 20 bp, Artificial Sequence
  Oligomeric compound
ctctttagaccagatccaca

SEQ ID NO: 1645 - DNA, 20 bp, Artificial Sequence
  Oligomeric compound
ctgaatggctgtgcaatcaa

SEQ ID NO: 1646 - DNA, 20 bp, Artificial Sequence
  Oligomeric compound
cttaaaataaaaccagaaag

SEQ ID NO: 1647 - DNA, 20 bp, Artificial Sequence
  Oligomeric compound
gagactcccaaccgcaccca

SEQ ID NO: 1648 - DNA, 20 bp, Artificial Sequence
  Oligomeric compound
gagctcttacctcccactgc

SEQ ID NO: 1649 - DNA, 20 bp, Artificial Sequence
  Oligomeric compound
gagtcgcctgagtcatcact

SEQ ID NO: 1650 - DNA, 20 bp, Artificial Sequence
  Oligomeric compound
gagtttgggacagcaatcac

SEQ ID NO: 1651 - DNA, 20 bp, Artificial Sequence
  Oligomeric compound
gatctgagcaccacccgcct

SEQ ID NO: 1652 - DNA, 20 bp, Artificial Sequence
  Oligomeric compound
gatctgagcataacccgcct

SEQ ID NO: 1653 - DNA, 20 bp, Artificial Sequence
  Oligomeric compound
gatgttactaaaatacctca

SEQ ID NO: 1654 - DNA, 20 bp, Artificial Sequence
  Oligomeric compound
gcagactcgcttccctgtgc

SEQ ID NO: 1655 - DNA, 20 bp, Artificial Sequence
  Oligomeric compound
gcataagcagccaccacagg

SEQ ID NO: 1656 - DNA, 20 bp, Artificial Sequence
  Oligomeric compound
gcatgagcagccaccacagg

SEQ ID NO: 1657 - DNA, 20 bp, Artificial Sequence
  Oligomeric compound
gccaggctcccaagaacctc

SEQ ID NO: 1658 - DNA, 20 bp, Artificial Sequence
  Oligomeric compound
gccataaataaagcgaacgc

SEQ ID NO: 1659 - DNA, 20 bp, Artificial Sequence
  Oligomeric compound
gcccaccagccatcacgagc

SEQ ID NO: 1660 - DNA, 20 bp, Artificial Sequence
  Oligomeric compound
gcccagtagccaccacaagc

SEQ ID NO: 1661 - DNA, 20 bp, Artificial Sequence
  Oligomeric compound
gctggataactgtgcatcaa

SEQ ID NO: 1662 - DNA, 20 bp, Artificial Sequence
  Oligomeric compound
ggaaagtcagaaaggtaact

SEQ ID NO: 1663 - DNA, 20 bp, Artificial Sequence
  Oligomeric compound
ggaggacagggagagcggcc

SEQ ID NO: 1664 - DNA, 20 bp, Artificial Sequence
  Oligomeric compound
ggcctggtttgatctgggat

SEQ ID NO: 1665 - DNA, 20 bp, Artificial Sequence
  Oligomeric compound
gggctgtatgcactttctcc

SEQ ID NO: 1666 - DNA, 20 bp, Artificial Sequence
  Oligomeric compound
ggggattaagtcttatccag

SEQ ID NO: 1667 - DNA, 20 bp, Artificial Sequence
  Oligomeric compound
gggtctccagctttacacca

SEQ ID NO: 1668 - DNA, 20 bp, Artificial Sequence
  Oligomeric compound
ggtagcacggagaggaccac

SEQ ID NO: 1669 - DNA, 20 bp, Artificial Sequence
  Oligomeric compound
ggtgaacacagtgcatgccc

SEQ ID NO: 1670 - DNA, 20 bp, Artificial Sequence
  Oligomeric compound
gtagaactcaaaaagctacc

SEQ ID NO: 1671 - DNA, 20 bp, Artificial Sequence
  Oligomeric compound
gtccagcaattgcccaagtc

SEQ ID NO: 1672 - DNA, 20 bp, Artificial Sequence
  Oligomeric compound
tagatgacgacacactacct

SEQ ID NO: 1673 - DNA, 20 bp, Artificial Sequence
  Oligomeric compound
tagatgcacacatcactacc

SEQ ID NO: 1674 - DNA, 20 bp, Artificial Sequence
  Oligomeric compound
tagtagggaggagacatact

SEQ ID NO: 1675 - DNA, 20 bp, Artificial Sequence
  Oligomeric compound
tcacaggcaggcacacgtga

SEQ ID NO: 1676 - DNA, 20 bp, Artificial Sequence
  Oligomeric compound
tcagaaagctcaccctccac

SEQ ID NO: 1677 - DNA, 20 bp, Artificial Sequence
  Oligomeric compound
tccatagcaaagtaatccat

SEQ ID NO: 1678 - DNA, 20 bp, Artificial Sequence
  Oligomeric compound
tccattaaccatgtccctca

SEQ ID NO: 1679 - DNA, 20 bp, Artificial Sequence
  Oligomeric compound
tccgatgatctttctgaatc

SEQ ID NO: 1680 - DNA, 20 bp, Artificial Sequence
  Oligomeric compound
tccttcagagcaacagagag

SEQ ID NO: 1681 - DNA, 20 bp, Artificial Sequence
  Oligomeric compound
tcggttgatcttgcagagcc

SEQ ID NO: 1682 - DNA, 20 bp, Artificial Sequence
  Oligomeric compound
tctgacactgacacaaccca

SEQ ID NO: 1683 - DNA, 20 bp, Artificial Sequence
  Oligomeric compound
tctgattggcaacggcctga

SEQ ID NO: 1684 - DNA, 20 bp, Artificial Sequence
  Oligomeric compound
tgatccgacaccctcatctc

SEQ ID NO: 1685 - DNA, 20 bp, Artificial Sequence
  Oligomeric compound
tgctcgttggatcttgaaga

SEQ ID NO: 1686 - DNA, 20 bp, Artificial Sequence
  Oligomeric compound
tggaaattggtacacagtcc

SEQ ID NO: 1687 - DNA, 20 bp, Artificial Sequence
  Oligomeric compound
tggaaccagtgggcacttcc

SEQ ID NO: 1688 - DNA, 20 bp, Artificial Sequence
  Oligomeric compound
tggaatgctctggagacaac

SEQ ID NO: 1689 - DNA, 20 bp, Artificial Sequence
  Oligomeric compound
tggcttccatagtctggtgt

SEQ ID NO: 1690 - DNA, 20 bp, Artificial Sequence
  Oligomeric compound
tgtacaatttgggagtcctg

SEQ ID NO: 1691 - DNA, 20 bp, Artificial Sequence
  Oligomeric compound
tgtatgatatctacctcagg

SEQ ID NO: 1692 - DNA, 20 bp, Artificial Sequence
  Oligomeric compound
tgtcacaaacacttactgga

SEQ ID NO: 1693 - DNA, 20 bp, Artificial Sequence
  Oligomeric compound
tgtcatatcatatcagaaca

SEQ ID NO: 1694 - DNA, 20 bp, Artificial Sequence
  Oligomeric compound
tgtgcggtccacttcaccac

SEQ ID NO: 1695 - DNA, 20 bp, Artificial Sequence
  Oligomeric compound
tgtgtgcggcgaaggccccg

SEQ ID NO: 1696 - DNA, 20 bp, Artificial Sequence
  Oligomeric compound
tgtttcgtcctcaataaaga

SEQ ID NO: 1697 - DNA, 20 bp, Artificial Sequence
  Oligomeric compound
tgtttcgtcctcattaaaga

SEQ ID NO: 1698 - DNA, 20 bp, Artificial Sequence
  Oligomeric compound
ttcagagctacagcatcggt

SEQ ID NO: 1699 - DNA, 20 bp, Artificial Sequence
  Oligomeric compound
ttctcatcaaagaaacagag

SEQ ID NO: 1700 - DNA, 20 bp, Artificial Sequence
  Oligomeric compound
ttgtaaccaccacagtacaa

SEQ ID NO: 1701 - DNA, 20 bp, Artificial Sequence
  Oligomeric compound
ttgtcagcaccgcactacaa

SEQ ID NO: 1702-1734 - skipped (33 entries)

SEQ ID NO: 1735 - DNA, 2008 bp, H. sapiens
acaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacgtaagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatatttt

SEQ ID NO: 1736 - DNA, 1919 bp, H. sapiens
gtctcagtcgccgctgccagctctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaacc

SEQ ID NO: 1737 - DNA, 1006 bp, H. sapiens
cgtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagatta

SEQ ID NO: 1738 - DNA, 4181 bp, H. sapiens
cctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagg

SEQ ID NO: 1739 - DNA, 827 bp, H. sapiens
cgggccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacat

SEQ ID NO: 1740 - DNA, 2845 bp, H. sapiens
cctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacgccgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggatcctgtttctaaagaaacccatgctgtgaaatagagacttttctactgatcatcataactctgtatctgagcagtgataccaaccacatctgaagtcaacagaagatccaagtttaaaattgctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaagaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcatcatcactataatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtcc

SEQ ID NO: 1741 - DNA, 2032 bp, H. sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 1742 - DNA, 2201 bp, H. sapiens
gggggtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggacttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcattttgggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactaatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataaaaaaaaaaaaaaaaaa

SEQ ID NO: 1743 - DNA, 2505 bp, H. sapiens
cacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattgacacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaataaaatggagaaaatgaaaaaaaaaaaaaaaaaaaa

SEQ ID NO: 1744 - DNA, 1478 bp, H. sapiens
cggaggtgggtagatagacccggagagacggcgaaggagctggaaaccgagccagggctgagccggctgacaacagttgcaggttccgatctttgggtactccaggagctgttctatagcccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctactttgtgtaaatatttatgtatatatgtatttttactattaatgtgtgcatttgtgttgagggaagataaatcctttctgattaaagaaatttttttatacctaaaaaaaaaaaaaaaaaaaaaaaaaaaaaaaaaaaaaaaaaaaaaaaa

SEQ ID NO: 1745 - DNA, 346 bp, H. sapiens
ataaacttcgccttaattttaataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgagccgaat

SEQ ID NO: 1746 - DNA, 6740 bp, H. sapiens
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactcgaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccatttgc

SEQ ID NO: 1747 - DNA, 2216 bp, H. sapiens
atttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgctttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttcctt

SEQ ID NO: 1748 - DNA, 2397 bp, H. sapiens; identical to SEQ ID NO: 820

SEQ ID NO: 1749 - DNA, 94 bp, Artificial Sequence
  DNA
aatttaatacgactcactatagggcgactgtaaacatcctcgactggaagctgtgaagccacagatgggctttcagtcggatgtttgcagctgc

SEQ ID NO: 1750 - RNA, 22 nt, Artificial Sequence
  Oligomeric compound
aaaaagguuagcuggguguguu

SEQ ID NO: 1751 - RNA, 23 nt, Artificial Sequence
  Oligomeric compound
aaaccacacaaccuacuaccuca

SEQ ID NO: 1752 - RNA, 23 nt, Artificial Sequence
  Oligomeric compound
aaaccauacaaccuacuaccuca

SEQ ID NO: 1753 - RNA, 22 nt, Artificial Sequence
  Oligomeric compound
aaacccagcagacaauguagcu

SEQ ID NO: 1754 - RNA, 21 nt, Artificial Sequence
  Oligomeric compound
aaagagaccgguucacuguga

SEQ ID NO: 1755 - RNA, 22 nt, Artificial Sequence
  Oligomeric compound
aaagagguuaaccagguguguu

SEQ ID NO: 1756 - RNA, 23 nt, Artificial Sequence
  Oligomeric compound
aaaggcaucauauaggagcugaa

SEQ ID NO: 1757 - RNA, 23 nt, Artificial Sequence
  Oligomeric compound
aaaggcaucauauaggagcugga

SEQ ID NO: 1758 - RNA, 21 nt, Artificial Sequence
  Oligomeric compound
aacaaaaucacaagucuucca

SEQ ID NO: 1759 - RNA, 23 nt, Artificial Sequence
  Oligomeric compound
aacaaccagcuaagacacugcca

SEQ ID NO: 1760 - RNA, 22 nt, Artificial Sequence
  Oligomeric compound
aacagcacaaacuacuaccuca

SEQ ID NO: 1761 - RNA, 22 nt, Artificial Sequence
  Oligomeric compound
aacagguagucugaacacuggg

SEQ ID NO: 1762 - RNA, 22 nt, Artificial Sequence
  Oligomeric compound
aaccaaugugcagacuacugua

SEQ ID NO: 1763 - RNA, 22 nt, Artificial Sequence
  Oligomeric compound
aacccauggaauucaguucuca

SEQ ID NO: 1764 - RNA, 22 nt, Artificial Sequence
  Oligomeric compound
aacuaugcaaccuacuaccucu

SEQ ID NO: 1765 - RNA, 22 nt, Artificial Sequence
  Oligomeric compound
aacuguacaaacuacuaccuca

SEQ ID NO: 1766 - RNA, 23 nt, Artificial Sequence
  Oligomeric compound
aagcccaaaaggagaauucuuug

SEQ ID NO: 1767 - RNA, 23 nt, Artificial Sequence
  Oligomeric compound
aauacauacuucuuuacauucca

SEQ ID NO: 1768 - RNA, 21 nt, Artificial Sequence
  Oligomeric compound
acaaaccauuaugugcugcua

SEQ ID NO: 1769 - RNA, 22 nt, Artificial Sequence
  Oligomeric compound
acaaauucggaucuacagggua

SEQ ID NO: 1770 - RNA, 20 nt, Artificial Sequence
  Oligomeric compound
acaagaucggaucuacgggu

SEQ ID NO: 1771 - RNA, 22 nt, Artificial Sequence
  Oligomeric compound
acaagcuuuuugcucgucuuau

SEQ ID NO: 1772 - RNA, 20 nt, Artificial Sequence
  Oligomeric compound
acaagugcccucacugcagu

SEQ ID NO: 1773 - RNA, 20 nt, Artificial Sequence
  Oligomeric compound
acaagugccuucacugcagu

SEQ ID NO: 1774 - RNA, 22 nt, Artificial Sequence
  Oligomeric compound
acacaaauucgguucuacaggg

SEQ ID NO: 1775 - RNA, 23 nt, Artificial Sequence
  Oligomeric compound
acaccaaugcccuaggggaugcg

SEQ ID NO: 1776 - RNA, 22 nt, Artificial Sequence
  Oligomeric compound
acacugauuucaaauggugcua

SEQ ID NO: 1777 - RNA, 23 nt, Artificial Sequence
  Oligomeric compound
acacuuacugagcaccuacuagg

SEQ ID NO: 1778 - RNA, 23 nt, Artificial Sequence
  Oligomeric compound
acacuuacuggacaccuacuagg

SEQ ID NO: 1779 - RNA, 24 nt, Artificial Sequence
  Oligomeric compound
acagcugcuuuugggauuccguug

SEQ ID NO: 1780 - RNA, 20 nt, Artificial Sequence
  Oligomeric compound
acaggagucugagcauuuga

SEQ ID NO: 1781 - RNA, 21 nt, Artificial Sequence
  Oligomeric compound
acaggauugagggggggcccu

SEQ ID NO: 1782 - RNA, 15 nt, Artificial Sequence
  Oligomeric compound
acagugcuucaucuc

SEQ ID NO: 1783 - RNA, 16 nt, Artificial Sequence
  Oligomeric compound
acagugcuucaucuca

SEQ ID NO: 1784 - RNA, 22 nt, Artificial Sequence
  Oligomeric compound
acaucguuaccagacaguguua

SEQ ID NO: 1785 - RNA, 23 nt, Artificial Sequence
  Oligomeric compound
acauuuuucguuauugcucuuga

SEQ ID NO: 1786 - RNA, 22 nt, Artificial Sequence
  Oligomeric compound
acccuccaccaugcaagggaug

SEQ ID NO: 1787 - RNA, 22 nt, Artificial Sequence
  Oligomeric compound
accuaauauaucaaacauauca

SEQ ID NO: 1788 - RNA, 21 nt, Artificial Sequence
  Oligomeric compound
accuauccugaauuacuugaa

SEQ ID NO: 1789 - RNA, 23 nt, Artificial Sequence
  Oligomeric compound
acgccaauauuuacgugcugcua

SEQ ID NO: 1790 - RNA, 22 nt, Artificial Sequence
  Oligomeric compound
acggaagggcagagagggccag

SEQ ID NO: 1791 - RNA, 21 nt, Artificial Sequence
  Oligomeric compound
acuauacaaucuacuaccuca

SEQ ID NO: 1792 - RNA, 23 nt, Artificial Sequence
  Oligomeric compound
acugauaucagcucaguaggcac

SEQ ID NO: 1793 - RNA, 20 nt, Artificial Sequence
  Oligomeric compound
acugauuucaaauggugcua

SEQ ID NO: 1794 - RNA, 21 nt, Artificial Sequence
  Oligomeric compound
acuggaggaagggcccagagg

SEQ ID NO: 1795 - RNA, 22 nt, Artificial Sequence
  Oligomeric compound
agaaaggcagcaggucguauag

SEQ ID NO: 1796 - RNA, 23 nt, Artificial Sequence
  Oligomeric compound
agacccaguagccagauguagcu

SEQ ID NO: 1797 - RNA, 23 nt, Artificial Sequence
  Oligomeric compound
agaggcaggcacucaggcagaca

SEQ ID NO: 1798 - RNA, 23 nt, Artificial Sequence
  Oligomeric compound
agaggcaggcacucgggcagaca

SEQ ID NO: 1799 - RNA, 23 nt, Artificial Sequence
  Oligomeric compound
agaggcaggcaugcgggcagaca

SEQ ID NO: 1800 - RNA, 22 nt, Artificial Sequence
  Oligomeric compound
agaggucgaccguguaaugugc

SEQ ID NO: 1801 - RNA, 23 nt, Artificial Sequence
  Oligomeric compound
agcaaaaaugugcuagugccaaa

SEQ ID NO: 1802 - RNA, 22 nt, Artificial Sequence
  Oligomeric compound
agcaagcccagaccgcaaaaag

SEQ ID NO: 1803 - RNA, 16 nt, Artificial Sequence
  Oligomeric compound
agcuacagugcuucau

SEQ ID NO: 1804 - RNA, 24 nt, Artificial Sequence
  Oligomeric compound
agcugagaguguaggauguuuaca

SEQ ID NO: 1805 - RNA, 22 nt, Artificial Sequence
  Oligomeric compound
agcugaguguaggauguuuaca

SEQ ID NO: 1806 - RNA, 22 nt, Artificial Sequence
  Oligomeric compound
agcugcuuuugggauuccguug

SEQ ID NO: 1807 - RNA, 24 nt, Artificial Sequence
  Oligomeric compound
agcuuccagucggggauguuuaca

SEQ ID NO: 1808 - RNA, 22 nt, Artificial Sequence
  Oligomeric compound
aggcaaaggaugacaaagggaa

SEQ ID NO: 1809 - RNA, 24 nt, Artificial Sequence
  Oligomeric compound
auccagucaguuccugaugcagua

SEQ ID NO: 1810 - RNA, 21 nt, Artificial Sequence
  Oligomeric compound
aucugcacugucagcacuuua

SEQ ID NO: 1811 - RNA, 22 nt, Artificial Sequence
  Oligomeric compound
augcccuuucaucauugcacug

SEQ ID NO: 1812 - RNA, 22 nt, Artificial Sequence
  Oligomeric compound
augcccuuuuaacauugcacug

SEQ ID NO: 1813 - RNA, 25 nt, Artificial Sequence
  Oligomeric compound
augcuuugacaauacuauugcacug

SEQ ID NO: 1814 - RNA, 22 nt, Artificial Sequence
  Oligomeric compound
augcuuuuugggguaagggcuu

SEQ ID NO: 1815 - RNA, 22 nt, Artificial Sequence
  Oligomeric compound
auguaugugggacgguaaacca

SEQ ID NO: 1816 - RNA, 22 nt, Artificial Sequence
  Oligomeric compound
caaacaccauugucacacucca

SEQ ID NO: 1817 - RNA, 22 nt, Artificial Sequence
  Oligomeric compound
caaucagcuaacuacacugccu

SEQ ID NO: 1818 - RNA, 22 nt, Artificial Sequence
  Oligomeric compound
caaucagcuaaugacacugccu

SEQ ID NO: 1819 - RNA, 23 nt, Artificial Sequence
  Oligomeric compound
caaucagcuaauuacacugccua

SEQ ID NO: 1820 - RNA, 23 nt, Artificial Sequence
  Oligomeric compound
cacaaauucgguucuacagggua

SEQ ID NO: 1821 - RNA, 22 nt, Artificial Sequence
  Oligomeric compound
cacaagaucggaucuacggguu

SEQ ID NO: 1822 - RNA, 22 nt, Artificial Sequence
  Oligomeric compound
cacauaggaaugaaaagccaua

SEQ ID NO: 1823 - RNA, 22 nt, Artificial Sequence
  Oligomeric compound
cacaugguuagaucaagcacaa

SEQ ID NO: 1824 - RNA, 22 nt, Artificial Sequence
  Oligomeric compound
cacugguacaaggguugggaga

SEQ ID NO: 1825 - RNA, 21 nt, Artificial Sequence
  Oligomeric compound
cagcuaugccagcaucuugcc

SEQ ID NO: 1826 - RNA, 22 nt, Artificial Sequence
  Oligomeric compound
cagcuaugccagcaucuugccu

SEQ ID NO: 1827 - RNA, 21 nt, Artificial Sequence
  Oligomeric compound
cagcuuucaaaaugaucucac

SEQ ID NO: 1828 - RNA, 23 nt, Artificial Sequence
  Oligomeric compound
caggcauaggaugacaaagggaa

SEQ ID NO: 1829 - RNA, 21 nt, Artificial Sequence
  Oligomeric compound
caggccgggacaagugcaaua

SEQ ID NO: 1830 - RNA, 24 nt, Artificial Sequence
  Oligomeric compound
caucauuaccaggcaguauuagag

SEQ ID NO: 1831 - RNA, 21 nt, Artificial Sequence
  Oligomeric compound
caucguuaccagacaguguua

SEQ ID NO: 1832 - RNA, 21 nt, Artificial Sequence
  Oligomeric compound
ccaacaacaugaaacuaccua

SEQ ID NO: 1833 - RNA, 20 nt, Artificial Sequence
  Oligomeric compound
ccaagcucagacggauccga

SEQ ID NO: 1834 - RNA, 20 nt, Artificial Sequence
  Oligomeric compound
ccagcagcaccuggggcagu

SEQ ID NO: 1835 - RNA, 22 nt, Artificial Sequence
  Oligomeric compound
ccagcagcaccuggggcagugg

SEQ ID NO: 1836 - RNA, 22 nt, Artificial Sequence
  Oligomeric compound
ccauaaaguaggaaacacuaca

SEQ ID NO: 1837 - RNA, 22 nt, Artificial Sequence
  Oligomeric compound
ccccuaucacgauuagcauuaa

SEQ ID NO: 1838 - RNA, 21 nt, Artificial Sequence
  Oligomeric compound
cccucuggucaaccagucaca

SEQ ID NO: 1839 - RNA, 19 nt, Artificial Sequence
  Oligomeric compound
ccuaucuccccucuggacc

SEQ ID NO: 1840 - RNA, 21 nt, Artificial Sequence
  Oligomeric compound
ccucaaggagccucagucuag

SEQ ID NO: 1841 - RNA, 22 nt, Artificial Sequence
  Oligomeric compound
ccucaaggagccucagucuagu

SEQ ID NO: 1842 - RNA, 22 nt, Artificial Sequence
  Oligomeric compound
ccucaaggagcuucagucuagu

SEQ ID NO: 1843 - RNA, 22 nt, Artificial Sequence
  Oligomeric compound
cgaaggcaacacggauaaccua

SEQ ID NO: 1844 - RNA, 22 nt, Artificial Sequence
  Oligomeric compound
cgaccauggcuguagacuguua

SEQ ID NO: 1845 - RNA, 22 nt, Artificial Sequence
  Oligomeric compound
cgcaaggucgguucuacgggug

SEQ ID NO: 1846 - RNA, 23 nt, Artificial Sequence
  Oligomeric compound
cggccugauucacaacaccagcu

SEQ ID NO: 1847 - RNA, 21 nt, Artificial Sequence
  Oligomeric compound
cggcugcaacacaagacacga

SEQ ID NO: 1848 - RNA, 17 nt, Artificial Sequence
  Oligomeric compound
cuacagugcuucaucuc

SEQ ID NO: 1849 - RNA, 23 nt, Artificial Sequence
  Oligomeric compound
cuaccugcacgaacagcacuuug

SEQ ID NO: 1850 - RNA, 23 nt, Artificial Sequence
  Oligomeric compound
cuaccugcacuguaagcacuuug

SEQ ID NO: 1851 - RNA, 21 nt, Artificial Sequence
  Oligomeric compound
cuagugguccuaaacauuuca

SEQ ID NO: 1852 - RNA, 23 nt, Artificial Sequence
  Oligomeric compound
cuaucugcacuagaugcaccuua

SEQ ID NO: 1853 - RNA, 22 nt, Artificial Sequence
  Oligomeric compound
cucaauagacugugagcuccuu

SEQ ID NO: 1854 - RNA, 22 nt, Artificial Sequence
  Oligomeric compound
cucaccgacagcguugaauguu

SEQ ID NO: 1855 - RNA, 22 nt, Artificial Sequence
  Oligomeric compound
cuggcugucaauucauagguca

SEQ ID NO: 1856 - RNA, 22 nt, Artificial Sequence
  Oligomeric compound
cuucagcuaucacaguacugua

SEQ ID NO: 1857 - RNA, 22 nt, Artificial Sequence
  Oligomeric compound
cuucaguuaucacaguacugua

SEQ ID NO: 1858 - RNA, 22 nt, Artificial Sequence
  Oligomeric compound
cuuccagucaaggauguuuaca

SEQ ID NO: 1859 - RNA, 23 nt, Artificial Sequence
  Oligomeric compound
gaacagguagucuaaacacuggg

SEQ ID NO: 1860 - RNA, 21 nt, Artificial Sequence
  Oligomeric compound
gaacccacaaucccuggcuua

SEQ ID NO: 1861 - RNA, 18 nt, Artificial Sequence
  Oligomeric compound
gaacugccuuucucucca

SEQ ID NO: 1862 - RNA, 24 nt, Artificial Sequence
  Oligomeric compound
gacgggugcgauuucugugugaga

SEQ ID NO: 1863 - RNA, 16 nt, Artificial Sequence
  Oligomeric compound
gagcuacagugcuuca

SEQ ID NO: 1864 - RNA, 21 nt, Artificial Sequence
  Oligomeric compound
gagcuacagugcuucaucuca

SEQ ID NO: 1865 - RNA, 21 nt, Artificial Sequence
  Oligomeric compound
gcaacuuaguaaugugcaaua

SEQ ID NO: 1866 - RNA, 23 nt, Artificial Sequence
  Oligomeric compound
gcaaucagcuaacuacacugccu

SEQ ID NO: 1867 - RNA, 17 nt, Artificial Sequence
  Oligomeric compound
gcacgaacagcacuuug

SEQ ID NO: 1868 - RNA, 21 nt, Artificial Sequence
  Oligomeric compound
gcacuggacuaggggucagca

SEQ ID NO: 1869 - RNA, 21 nt, Artificial Sequence
  Oligomeric compound
gcagaacuuagccacugugaa

SEQ ID NO: 1870 - RNA, 20 nt, Artificial Sequence
  Oligomeric compound
gcagaagcauuuccacacac

SEQ ID NO: 1871 - RNA, 21 nt, Artificial Sequence
  Oligomeric compound
gcauuauuacucacgguacga

SEQ ID NO: 1872 - RNA, 21 nt, Artificial Sequence
  Oligomeric compound
gcccuggacuaggagucagca

SEQ ID NO: 1873 - RNA, 21 nt, Artificial Sequence
  Oligomeric compound
gccuauccuggauuacuugaa

SEQ ID NO: 1874 - RNA, 21 nt, Artificial Sequence
  Oligomeric compound
gcggaacuuagccacugugaa

SEQ ID NO: 1875 - RNA, 16 nt, Artificial Sequence
  Oligomeric compound
gcuacagugcuucauc

SEQ ID NO: 1876 - RNA, 17 nt, Artificial Sequence
  Oligomeric compound
gcuacagugcuucaucu

SEQ ID NO: 1877 - RNA, 21 nt, Artificial Sequence
  Oligomeric compound
gcuggaggaagggcccagagg

SEQ ID NO: 1878 - RNA, 23 nt, Artificial Sequence
  Oligomeric compound
gcuggaugcaaaccugcaaaacu

SEQ ID NO: 1879 - RNA, 22 nt, Artificial Sequence
  Oligomeric compound
gcuggguggagaagguggugaa

SEQ ID NO: 1880 - RNA, 23 nt, Artificial Sequence
  Oligomeric compound
gcuuccagucgaggauguuuaca

SEQ ID NO: 1881 - RNA, 23 nt, Artificial Sequence
  Oligomeric compound
gcuuugacaauacuauugcacug

SEQ ID NO: 1882 - RNA, 19 nt, Artificial Sequence
  Oligomeric compound
ggaacuuagccacugugaa

SEQ ID NO: 1883 - RNA, 21 nt, Artificial Sequence
  Oligomeric compound
ggauuccugggaaaacuggac

SEQ ID NO: 1884 - RNA, 22 nt, Artificial Sequence
  Oligomeric compound
ggcggaacuuagccacugugaa

SEQ ID NO: 1885 - RNA, 23 nt, Artificial Sequence
  Oligomeric compound
ggcuauaaaguaacugagacgga

SEQ ID NO: 1886 - RNA, 21 nt, Artificial Sequence
  Oligomeric compound
guaaaccaugaugugcugcua

SEQ ID NO: 1887 - RNA, 23 nt, Artificial Sequence
  Oligomeric compound
gucaucauuaccaggcaguauua

SEQ ID NO: 1888 - RNA, 23 nt, Artificial Sequence
  Oligomeric compound
uaaacggaaccacuagugacuua

SEQ ID NO: 1889 - RNA, 23 nt, Artificial Sequence
  Oligomeric compound
uaaacggaaccacuagugacuug

SEQ ID NO: 1890 - RNA, 22 nt, Artificial Sequence
  Oligomeric compound
uaaccgauuucaaauggugcua

SEQ ID NO: 1891 - RNA, 22 nt, Artificial Sequence
  Oligomeric compound
uaaccgauuucagauggugcua

SEQ ID NO: 1892 - RNA, 21 nt, Artificial Sequence
  Oligomeric compound
uacauacuucuuuacauucca

SEQ ID NO: 1893 - RNA, 22 nt, Artificial Sequence
  Oligomeric compound
uaccugcacuauaagcacuuua

SEQ ID NO: 1894 - RNA, 22 nt, Artificial Sequence
  Oligomeric compound
uaccugcacuguuagcacuuug

SEQ ID NO: 1895 - RNA, 22 nt, Artificial Sequence
  Oligomeric compound
uacuagacugugagcuccucga

SEQ ID NO: 1896 - RNA, 22 nt, Artificial Sequence
  Oligomeric compound
uacuuucgguuaucuagcuuua

SEQ ID NO: 1897 - RNA, 21 nt, Artificial Sequence
  Oligomeric compound
uaggagagagaaaaagacuga

SEQ ID NO: 1898 - RNA, 21 nt, Artificial Sequence
  Oligomeric compound
uaguuggcaagucuagaacca

SEQ ID NO: 1899 - RNA, 22 nt, Artificial Sequence
  Oligomeric compound
uauggcagacugugauuuguug

SEQ ID NO: 1900 - RNA, 23 nt, Artificial Sequence
  Oligomeric compound
ucaacaaaaucacugaugcugga

SEQ ID NO: 1901 - RNA, 23 nt, Artificial Sequence
  Oligomeric compound
ucacauaggaauaaaaagccaua

SEQ ID NO: 1902 - RNA, 23 nt, Artificial Sequence
  Oligomeric compound
ucaccaaaacauggaagcacuua

SEQ ID NO: 1903 - RNA, 22 nt, Artificial Sequence
  Oligomeric compound
ucagaccgagacaagugcaaug

SEQ ID NO: 1904 - RNA, 23 nt, Artificial Sequence
  Oligomeric compound
ucauacagcuagauaaccaaaga

SEQ ID NO: 1905 - RNA, 22 nt, Artificial Sequence
  Oligomeric compound
ucaucauuaccaggcaguauua

SEQ ID NO: 1906 - RNA, 22 nt, Artificial Sequence
  Oligomeric compound
uccacauggaguugcuguuaca

SEQ ID NO: 1907 - RNA, 20 nt, Artificial Sequence
  Oligomeric compound
uccagucaaggauguuuaca

SEQ ID NO: 1908 - RNA, 23 nt, Artificial Sequence
  Oligomeric compound
uccauaaaguaggaaacacuaca

SEQ ID NO: 1909 - RNA, 23 nt, Artificial Sequence
  Oligomeric compound
uccaucaucaaaacaaauggagu

SEQ ID NO: 1910 - RNA, 22 nt, Artificial Sequence
  Oligomeric compound
uccaucauuacccggcaguauu

SEQ ID NO: 1911 - RNA, 22 nt, Artificial Sequence
  Oligomeric compound
uccgugguucuacccuguggua

SEQ ID NO: 1912 - RNA, 22 nt, Artificial Sequence
  Oligomeric compound
ucuagugguccuaaacauuuca

SEQ ID NO: 1913 - RNA, 23 nt, Artificial Sequence
  Oligomeric compound
ucucugcaggcccugugcuuugc

SEQ ID NO: 1914 - RNA, 23 nt, Artificial Sequence
  Oligomeric compound
ucucugcaggccgugugcuuugc

SEQ ID NO: 1915 - RNA, 22 nt, Artificial Sequence
  Oligomeric compound
ucuucccaugcgcuauaccucu

SEQ ID NO: 1916 - RNA, 16 nt, Artificial Sequence
  Oligomeric compound
ugagcuacagugcuuc

SEQ ID NO: 1917 - RNA, 21 nt, Artificial Sequence
  Oligomeric compound
ugagcuccuggaggacaggga

SEQ ID NO: 1918 - RNA, 21 nt, Artificial Sequence
  Oligomeric compound
uggcauucaccgcgugccuua

SEQ ID NO: 1919 - RNA, 21 nt, Artificial Sequence
  Oligomeric compound
uguaagugcucguaaugcagu

SEQ ID NO: 1920 - RNA, 18 nt, Artificial Sequence
  Oligomeric compound
ugucaauucauaggucag

SEQ ID NO: 1921 - RNA, 24 nt, Artificial Sequence
  Oligomeric compound
uguccgugguucuacccuguggua

SEQ ID NO: 1922 - RNA, 23 nt, Artificial Sequence
  Oligomeric compound
uucgcccucucaacccagcuuuu

SEQ ID NO: 1923 - RNA, 21 nt, Artificial Sequence
  Oligomeric compound
uucuaggauaggcccaggggc

SEQ ID NO: 1924 - RNA, 23 nt, Artificial Sequence
  Oligomeric compound
uuggcauucaccgcgugccuuaa

SEQ ID NO: 1925 - RNA, 21 nt, Artificial Sequence
  Oligomeric compound
uuuaagugcucauaaugcagu

SEQ ID NO: 1926 - RNA, 22 nt, Artificial Sequence
  Oligomeric compound
uuuucccaugcccuauaccucu

SEQ ID NO: 1927 - skipped

SEQ ID NO: 1928 - DNA, 255 bp, H. sapiens
gaattcgcggccgcgtcgaccgcttctgtggccacggcagatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactc

SEQ ID NO: 1929 - DNA, 255 bp, H. sapiens
atgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcg

SEQ ID NO: 1930 - DNA, 255 bp, H. sapiens
gatgcctgatctcatcaatctagcgggagagacaggataacctgtccgagagtatagcgccacttatgactccgccggaaaaattactttaaaaatcgccaaaaattacttggagcaaagggcagtccggcggcgttcgccaaggtggcgcagtcggttttgacctgtagcagagaaccaattctggagaacagcctcacttctttgattgaatacttacataatgcattggaacatgacatgagattaaggttt

SEQ ID NO: 1931 - DNA, 255 bp, H. sapiens
tttttatttttttcgagtgaaggacccggagccgaaacaccggtagagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagac

SEQ ID NO: 1932 - DNA, 255 bp, H. sapiens
agggcgctccaggcgacacgattgcagacgccattatcctctgtttctctgctgcaccgacctcgacgtcttgcctgtgtcccacttgttcgcggcctataggctactgcagcactggggtgtcagttgttggtccgacccagaacgcttcagttgtgctctgcaaggatatataataactgattggtgtgcccgtttaataaaagaatatggaaactgaacagccagaagaaaccttccctaacactgaaacca

SEQ ID NO: 1933 - DNA, 255 bp, H. sapiens
acctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagag

SEQ ID NO: 1934 - DNA, 255 bp, H. sapiens
tgccgctggagccggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatc

SEQ ID NO: 1935 - DNA, 255 bp, H. sapiens
caggcggcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgc

SEQ ID NO: 1936 - DNA, 255 bp, H. sapiens
cagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggca

SEQ ID NO: 1937 - DNA, 255 bp, H. sapiens
ctccaggcacacgcagcacacacagcacatgcaccacacgtagcacacacactgcatgcagcacacacacaccagaggacgcaccacacagagcacgcacagcacacaccacacagcgcacgcaccacacagagcacacgcggcacacacagcacacacagcgcacgcaccacgcagagcacacacggcacatgcagcatacacaccaaacagcgcatgcaccacacagagcacacgcggcacacgcagcacaca

SEQ ID NO: 1938 - DNA, 255 bp, H. sapiens
ctcctcacagaagcctggagctgggcatccaagaagaagcagcctcatttgttttctggtgtcatcgtaggtggccacctatggcttttgggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgataga

SEQ ID NO: 1939 - DNA, 255 bp, H. sapiens
ggcacgaggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagccccta

SEQ ID NO: 1940 - DNA, 255 bp, H. sapiens
atgctgggggaggggctggcggcctcgacggcagctgcggaactaggccgagggacaaaggctaagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacc

SEQ ID NO: 1941 - DNA, 255 bp, H. sapiens
agtgcggcggcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccg

SEQ ID NO: 1942 - DNA, 255 bp, H. sapiens
  misc_feature 77, 85: n = A,T,C or G
ctatgatggccagccaccgctgagagcacgaagctgctgctggctggcatttttctctagcgttgtggtgccacctncccttatnaccttgggacaagaagggaaggtggccattgtctttctctttggaatcataaagtggaacagagtccccagaactcatgtggccatttccgccagcatcactccccggtgcctatggggtcccggtgtacctaaagggagaaggaccccatgtgctagccagaaatatac

SEQ ID NO: 1943 - DNA, 255 bp, H. sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgc

SEQ ID NO: 1944 - DNA, 255 bp, H. sapiens
ccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttt

SEQ ID NO: 1945 - DNA, 255 bp, H. sapiens
gcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagc

SEQ ID NO: 1946 - DNA, 255 bp, H. sapiens
atgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctg

SEQ ID NO: 1947 - DNA, 255 bp, H. sapiens
caacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtc

SEQ ID NO: 1948 - DNA, 255 bp, H. sapiens
cagagcagggtggagagggcggtgggaggcgtgtgcctgagtgggctctactgccttgttccatattattttgtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctg

SEQ ID NO: 1949 - DNA, 255 bp, H. sapiens
gtgatttgctggaattgtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagac

SEQ ID NO: 1950 - DNA, 255 bp, H. sapiens
taaatgaaagcaacaggagctgctccggggactgcttttgccagcacccagaatcagtgctcaggctcagaaatcctggatagaaagagcattttataaaagagaatgtgtccacatcatacccagcaccaaagacccccataggtgttgctgtgggcgtctgataggccagcatgctggcctcacccccagtatctccgtgcttcagaatgagaaaaatgaaagtcgcctctcccgaaatgacatccagtctga

SEQ ID NO: 1951 - DNA, 255 bp, H. sapiens
ggctgaaagagcctgagctgtgcctctccattccactgctgtggcagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacaccc

SEQ ID NO: 1952 - DNA, 255 bp, H. sapiens
ctcagctacgcaggtgcaacttcttgcgccaacgtctggtcctgtctaccctgagcgggcgccccgtcaaaatccgaaagattcgggccagagacgacaacccgggcctccgagattttgaagccagcttcataaggctattggacaaataacgaatggttctcgaattgaaataaaccaaacaggaacaaccttatattatcagcctggcctcctgtatggtggatctgtggaacatgactgtagcgtccttcg

SEQ ID NO: 1953 - DNA, 255 bp, H. sapiens
ttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtat

SEQ ID NO: 1954 - DNA, 255 bp, H. sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctccccccc

SEQ ID NO: 1955 - DNA, 255 bp, H. sapiens
ggcggcgagcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgt

SEQ ID NO: 1956 - DNA, 255 bp, H. sapiens
ggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaac

SEQ ID NO: 1957 - DNA, 255 bp, H. sapiens
taacgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcga

SEQ ID NO: 1958 - DNA, 255 bp, H. sapiens
ggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgag

SEQ ID NO: 1959 - DNA, 255 bp, H. sapiens
cagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaa

SEQ ID NO: 1960 - DNA, 255 bp, H. sapiens
tgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagc

SEQ ID NO: 1961 - DNA, 255 bp, H. sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcg

SEQ ID NO: 1962 - DNA, 255 bp, H. sapiens
agcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtg

SEQ ID NO: 1963 - DNA, 255 bp, H. sapiens
gcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctg

SEQ ID NO: 1964 - DNA, 255 bp, H. sapiens
tctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggt

SEQ ID NO: 1965 - DNA, 255 bp, H. sapiens
ctacgtgcaaaagcagaatgggaaggctaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcag

SEQ ID NO: 1966 - DNA, 255 bp, H. sapiens
agcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctca

SEQ ID NO: 1967 - DNA, 255 bp, H. sapiens
ggcacgaggctggtccctggcccaacatgatactgaccaaagctcagtacgacgagatagcccagtgcctagtgtctgtgccgcctaccaggcagagcctgaggaagctgaagcagaggtttcccagtcaatcgcaggccactctgctgagcatcttctcccaggagtaccagaaacacattaaaagaacacatgccaaacatcatacttcggaagcaattgaaagttattaccagaggtacctgaatggagtgg

SEQ ID NO: 1968 - DNA, 255 bp, H. sapiens
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaccagcctgtattgagcggtttgcagcctgatgctcagccccctccccacagggcccctagaagcctgtttctccgtacagtccaggacctccagccc

SEQ ID NO: 1969 - DNA, 255 bp, H. sapiens
gagcagcggacgccggtctctgttccgcagatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtc

SEQ ID NO: 1970 - DNA, 255 bp, H. sapiens
atgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactg

SEQ ID NO: 1971 - DNA, 255 bp, H. sapiens
agggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggct

SEQ ID NO: 1972 - DNA, 255 bp, H. sapiens
ggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggc

SEQ ID NO: 1973 - DNA, 255 bp, H. sapiens
atgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggcctttt

SEQ ID NO: 1974 - DNA, 255 bp, H. sapiens
gttctctcgctcaggtctctgcatgtagttgtcacttgcagctccatttccatcacgtggtaaaatgccctttctcttctttcctgcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggcaaaaactgg

SEQ ID NO: 1975 - DNA, 255 bp, H. sapiens
tccgggtatggatgtcaatcttttgtctacaatgtgaatacatttatccttcggggaccatcaagactttcaggaaaggccccgcctgtctctgcgcggccactttgctgggacaaaggtcaactgaagaagtgggcaggcccgaggcaggagagatgctgaggagtccatgtgcaggggagggaaagggagaggcagtcagggagaggaggaggaggtaccgccagaaggggatcctcccgctccgaaaaccag

SEQ ID NO: 1976 - DNA, 255 bp, H. sapiens
gaattccttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcc

SEQ ID NO: 1977 - DNA, 255 bp, H. sapiens
gacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtgg

SEQ ID NO: 1978 - DNA, 255 bp, H. sapiens
cgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccc

SEQ ID NO: 1979 - DNA, 255 bp, H. sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcac

SEQ ID NO: 1980 - DNA, 255 bp, H. sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctact

SEQ ID NO: 1981 - DNA, 255 bp, H. sapiens
ggctgcccgagcgagcgttcggacctcgcaccccgcgcgccccgcgccgccgccgccgccggcttttgttgtctccgcctcctcggccgccgccgcctctggaccgcgagccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctat

SEQ ID NO: 1982 - DNA, 255 bp, H. sapiens
ccgcctggaggcacaggccatgaggggctctcaggaggtgctgctgatgtggcttctggtgttggcagtgggcggcacagagcacgcctaccggcccggccgtagggtgtgtgctgtccgggctcacggggatcctgtctccgagtcgttcgtgcagcgtgtgtaccagcccttcctcaccacctgcgacgggcaccgggcctgcagcacctaccgaaccatctataggaccgcctaccgccgcagccctgggct

SEQ ID NO: 1983 - DNA, 255 bp, H. sapiens
atgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgt

SEQ ID NO: 1984 - DNA, 255 bp, H. sapiens
ggagctccaacctccgcttagagctcgctgcggccgtcctgccccgtgccctcggagacctggaccgtaccacgatgtggaaacgctggctcgcgctcgcgctagcgctggtggcggtcgcctgggtccgcgccgaggaagagctaaggagcaaatccaagatctgtgccaatgtgttttgtggagctggccgggaatgtgcagtcacagagaaaggggaacccacctgtctctgcattgagcaatgcaaacctc

SEQ ID NO: 1985 - DNA, 255 bp, H. sapiens
ccttccggtcaccatggcgaccaggcgccttggggtcggggagacgctgggggccctcaacgcggccctggggccaggcggtccggtgtggaccaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgac

SEQ ID NO: 1986 - DNA, 255 bp, H. sapiens
tcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagc

SEQ ID NO: 1987 - DNA, 255 bp, H. sapiens
tgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccagaggacaagtcg

SEQ ID NO: 1988 - DNA, 255 bp, H. sapiens
gaggctgttaatgccaaatgctcctcactggagaagaccaagcaccggctacagaatgagatagaggacttgatggtggacgtagagcgctccaatgctgctgctgctgctctggacaagaagcagaggaactttgacaagatcctggccgagtggaagcagaagtatgaggagtcgcagtctgagctggagtcctcacagaaggaggctcgctccctcagcacagagctcttcaagctcaagaacgcctacgag

SEQ ID NO: 1989 - DNA, 255 bp, H. sapiens
cagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgcggggccagcaggtcttcctca

SEQ ID NO: 1990 - DNA, 255 bp, H. sapiens
cggccagcacaccccggcacctcctctgcggcagctgcgcctcgcaagcgcagtgccgcagcgcacgccggagtggctgtagctgcctcggcgcggctgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgag

SEQ ID NO: 1991 - DNA, 255 bp, H. sapiens
ctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcct

SEQ ID NO: 1992 - DNA, 255 bp, H. sapiens
ggcacgagtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaatta

SEQ ID NO: 1993 - DNA, 255 bp, H. sapiens
gccagagcgtgagccgcgacctccgcgcaggtggtcgcgccggtctccgcggaaatgttgtccaaagttcttccagtcctcctaggcatcttattgatcctccagtcgagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaa

SEQ ID NO: 1994 - DNA, 255 bp, H. sapiens
acgcgtccggggaaacggtgcaaacggcgtggccgccatcttgcttgtgcccccgcttcgcgcgcgctccgtgacgcacacttcccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagtctacagtcgttctggc

SEQ ID NO: 1995 - DNA, 20 bp, Artificial Sequence
  Oligomeric compound
gctgacctttttgcttctca

SEQ ID NO: 1996 - DNA, 20 bp, Artificial Sequence
  Oligomeric compound
cataaacatttccatcagtg

SEQ ID NO: 1997 - DNA, 15 bp, Artificial Sequence
  Oligomeric compound
aaacggggggaggca

SEQ ID NO: 1998 - DNA, 15 bp, Artificial Sequence
  Oligomeric compound
gccaaaaacgggggg

SEQ ID NO: 1999 - DNA, 15 bp, Artificial Sequence
  Oligomeric compound
attgccaaaaacggg

SEQ ID NO: 2000 - DNA, 15 bp, Artificial Sequence
  Oligomeric compound
accattgccaaaaac

SEQ ID NO: 2001 - DNA, 15 bp, Artificial Sequence
  Oligomeric compound
tctaccattgccaaa

SEQ ID NO: 2002 - DNA, 15 bp, Artificial Sequence
  Oligomeric compound
tgtgagttctaccat

SEQ ID NO: 2003 - DNA, 15 bp, Artificial Sequence
  Oligomeric compound
cagtgtgagttctac

SEQ ID NO: 2004 - DNA, 15 bp, Artificial Sequence
  Oligomeric compound
caccagtgtgagttc

SEQ ID NO: 2005 - DNA, 15 bp, Artificial Sequence
  Oligomeric compound
cctcaccagtgtgag

SEQ ID NO: 2006 - DNA, 15 bp, Artificial Sequence
  Oligomeric compound
tcctgttacctcacc

SEQ ID NO: 2007 - DNA, 15 bp, Artificial Sequence
  Oligomeric compound
gatcctgttacctca

SEQ ID NO: 2008 - DNA, 15 bp, Artificial Sequence
  Oligomeric compound
cggatcctgttacct

SEQ ID NO: 2009 - DNA, 15 bp, Artificial Sequence
  Oligomeric compound
tgttacctcaccagt

SEQ ID NO: 2010 - DNA, 15 bp, Artificial Sequence
  Oligomeric compound
cctgttacctcacca

SEQ ID NO: 2011 - DNA, 15 bp, Artificial Sequence
  Oligomeric compound
atcctgttacctcac

SEQ ID NO: 2012 - DNA, 15 bp, Artificial Sequence
  Oligomeric compound
ggatcctgttacctc

SEQ ID NO: 2013 - DNA, 15 bp, Artificial Sequence
  Oligomeric compound
ccggatcctgttacc

SEQ ID NO: 2014 - DNA, 15 bp, Artificial Sequence
  Oligomeric compound
gaaccaccggatcct

SEQ ID NO: 2015 - DNA, 15 bp, Artificial Sequence
  Oligomeric compound
ctagaaccaccggat

SEQ ID NO: 2016 - DNA, 15 bp, Artificial Sequence
  Oligomeric compound
agtctagaaccaccg

SEQ ID NO: 2017 - DNA, 15 bp, Artificial Sequence
  Oligomeric compound
gcaagtctagaacca

SEQ ID NO: 2018 - DNA, 15 bp, Artificial Sequence
  Oligomeric compound
atagttggcaagtct

SEQ ID NO: 2019 - DNA, 15 bp, Artificial Sequence
  Oligomeric compound
cgccccatagttggc

SEQ ID NO: 2020 - DNA, 15 bp, Artificial Sequence
  Oligomeric compound
cctcgccccatagtt

SEQ ID NO: 2021 - DNA, 15 bp, Artificial Sequence
  Oligomeric compound
agtcctcgccccata

SEQ ID NO: 2022 - DNA, 15 bp, Artificial Sequence
  Oligomeric compound
ctgagtcctcgcccc

SEQ ID NO: 2023 - DNA, 15 bp, Artificial Sequence
  Oligomeric compound
aagccaactcacagc

SEQ ID NO: 2024 - DNA, 15 bp, Artificial Sequence
  Oligomeric compound
agattaagccaactc

SEQ ID NO: 2025 - DNA, 15 bp, Artificial Sequence
  Oligomeric compound
ctgagattaagccaa

SEQ ID NO: 2026 - DNA, 15 bp, Artificial Sequence
  Oligomeric compound
cagctgagattaagc

SEQ ID NO: 2027 - DNA, 15 bp, Artificial Sequence
  Oligomeric compound
tgccagctgagatta

SEQ ID NO: 2028 - DNA, 15 bp, Artificial Sequence
  Oligomeric compound
tcacagttgccagct

SEQ ID NO: 2029 - DNA, 15 bp, Artificial Sequence
  Oligomeric compound
atctcacagttgcca

SEQ ID NO: 2030 - DNA, 15 bp, Artificial Sequence
  Oligomeric compound
aacatctcacagttg

SEQ ID NO: 2031 - DNA, 15 bp, Artificial Sequence
  Oligomeric compound
atgaacatctcacag

SEQ ID NO: 2032 - DNA, 15 bp, Artificial Sequence
  Oligomeric compound
attgtatgaacatct

SEQ ID NO: 2033 - DNA, 15 bp, Artificial Sequence
  Oligomeric compound
ggattgtatgaacat

SEQ ID NO: 2034 - DNA, 15 bp, Artificial Sequence
  Oligomeric compound
agggattgtatgaac

SEQ ID NO: 2035 - DNA, 15 bp, Artificial Sequence
  Oligomeric compound
tgtatgaacatctca

SEQ ID NO: 2036 - DNA, 15 bp, Artificial Sequence
  Oligomeric compound
tgagggattgtatga

SEQ ID NO: 2037 - DNA, 15 bp, Artificial Sequence
  Oligomeric compound
actgtgagggattgt

SEQ ID NO: 2038 - DNA, 15 bp, Artificial Sequence
  Oligomeric compound
accactgtgagggat

SEQ ID NO: 2039 - DNA, 15 bp, Artificial Sequence
  Oligomeric compound
gagaccactgtgagg

SEQ ID NO: 2040 - DNA, 15 bp, Artificial Sequence
  Oligomeric compound
ccagagaccactgtg

SEQ ID NO: 2041 - DNA, 15 bp, Artificial Sequence
  Oligomeric compound
cataatcccagagac

SEQ ID NO: 2042 - DNA, 15 bp, Artificial Sequence
  Oligomeric compound
gtttagcataatccc

SEQ ID NO: 2043 - DNA, 15 bp, Artificial Sequence
  Oligomeric compound
tctgtttagcataat

SEQ ID NO: 2044 - DNA, 15 bp, Artificial Sequence
  Oligomeric compound
tgctctgtttagcat

SEQ ID NO: 2045 - DNA, 15 bp, Artificial Sequence
  Oligomeric compound
aattgctctgtttag

SEQ ID NO: 2046 - DNA, 15 bp, Artificial Sequence
  Oligomeric compound
aggctgggagacagg

SEQ ID NO: 2047 - DNA, 15 bp, Artificial Sequence
  Oligomeric compound
acctcaggctgggag

SEQ ID NO: 2048 - DNA, 15 bp, Artificial Sequence
  Oligomeric compound
tgcacctcaggctgg

SEQ ID NO: 2049 - DNA, 15 bp, Artificial Sequence
  Oligomeric compound
cactgcacctcaggc

SEQ ID NO: 2050 - DNA, 15 bp, Artificial Sequence
  Oligomeric compound
cagcactgcacctca

SEQ ID NO: 2051 - DNA, 15 bp, Artificial Sequence
  Oligomeric compound
agagatgcagcactg

SEQ ID NO: 2052 - DNA, 15 bp, Artificial Sequence
  Oligomeric compound
accagagatgcagca

SEQ ID NO: 2053 - DNA, 15 bp, Artificial Sequence
  Oligomeric compound
ctgaccagagatgca

SEQ ID NO: 2054 - DNA, 15 bp, Artificial Sequence
  Oligomeric compound
caactgaccagagat

SEQ ID NO: 2055 - DNA, 15 bp, Artificial Sequence
  Oligomeric compound
cagactcccaactga

SEQ ID NO: 2056 - DNA, 15 bp, Artificial Sequence
  Oligomeric compound
ctcagactcccaact

SEQ ID NO: 2057 - DNA, 15 bp, Artificial Sequence
  Oligomeric compound
atctcagactcccaa

SEQ ID NO: 2058 - DNA, 15 bp, Artificial Sequence
  Oligomeric compound
aactgaccagagatg

SEQ ID NO: 2059 - DNA, 15 bp, Artificial Sequence
  Oligomeric compound
ccaactgaccagaga

SEQ ID NO: 2060 - DNA, 15 bp, Artificial Sequence
  Oligomeric compound
tcccaactgaccaga

SEQ ID NO: 2061 - DNA, 15 bp, Artificial Sequence
  Oligomeric compound
actcccaactgacca

SEQ ID NO: 2062 - DNA, 15 bp, Artificial Sequence
  Oligomeric compound
ttcatctcagactcc

SEQ ID NO: 2063 - DNA, 15 bp, Artificial Sequence
  Oligomeric compound
tgcttcatctcagac

SEQ ID NO: 2064 - DNA, 15 bp, Artificial Sequence
  Oligomeric compound
cagtgcttcatctca

SEQ ID NO: 2065 - DNA, 15 bp, Artificial Sequence
  Oligomeric compound
tgagctacagtgctt

SEQ ID NO: 2066 - DNA, 15 bp, Artificial Sequence
  Oligomeric compound
tcttcctgagctaca

SEQ ID NO: 2067 - DNA, 15 bp, Artificial Sequence
  Oligomeric compound
ctctcttcctgagct

SEQ ID NO: 2068 - DNA, 15 bp, Artificial Sequence
  Oligomeric compound
cttctctcttcctga

SEQ ID NO: 2069 - DNA, 15 bp, Artificial Sequence
  Oligomeric compound
caacttctctcttcc

SEQ ID NO: 2070 - DNA, 15 bp, Artificial Sequence
  Oligomeric compound
agcagccagagcacc

SEQ ID NO: 2071 - DNA, 15 bp, Artificial Sequence
  Oligomeric compound
acccaagcagccaga

SEQ ID NO: 2072 - DNA, 15 bp, Artificial Sequence
  Oligomeric compound
ggaacccaagcagcc

SEQ ID NO: 2073 - DNA, 15 bp, Artificial Sequence
  Oligomeric compound
ccaggaacccaagca

SEQ ID NO: 2074 - DNA, 15 bp, Artificial Sequence
  Oligomeric compound
atgccaggaacccaa

SEQ ID NO: 2075 - DNA, 15 bp, Artificial Sequence
  Oligomeric compound
aatcagcatgccagg

SEQ ID NO: 2076 - DNA, 15 bp, Artificial Sequence
  Oligomeric compound
acaaatcagcatgcc

SEQ ID NO: 2077 - DNA, 15 bp, Artificial Sequence
  Oligomeric compound
gtcacaaatcagcat

SEQ ID NO: 2078 - DNA, 15 bp, Artificial Sequence
  Oligomeric compound
taagtcacaaatcag

SEQ ID NO: 2079 - DNA, 15 bp, Artificial Sequence
  Oligomeric compound
aatcttaagtcacaa

SEQ ID NO: 2080 - DNA, 15 bp, Artificial Sequence
  Oligomeric compound
ttaatcttaagtcac

SEQ ID NO: 2081 - DNA, 15 bp, Artificial Sequence
  Oligomeric compound
ttttaatcttaagtc

SEQ ID NO: 2082 - DNA, 15 bp, Artificial Sequence
  Oligomeric compound
cttaagtcacaaatc

SEQ ID NO: 2083 - DNA, 15 bp, Artificial Sequence
  Oligomeric compound
atcttaagtcacaaa

SEQ ID NO: 2084 - DNA, 15 bp, Artificial Sequence
  Oligomeric compound
taatcttaagtcaca

SEQ ID NO: 2085 - DNA, 15 bp, Artificial Sequence
  Oligomeric compound
tttaatcttaagtca

SEQ ID NO: 2086 - DNA, 15 bp, Artificial Sequence
  Oligomeric compound
attttaatcttaagt

SEQ ID NO: 2087 - DNA, 15 bp, Artificial Sequence
  Oligomeric compound
tgtgattttaatctt

SEQ ID NO: 2088 - DNA, 15 bp, Artificial Sequence
  Oligomeric compound
caatgtgattttaat

SEQ ID NO: 2089 - DNA, 15 bp, Artificial Sequence
  Oligomeric compound
tggcaatgtgatttt

SEQ ID NO: 2090 - DNA, 15 bp, Artificial Sequence
  Oligomeric compound
ccctggcaatgtgat

SEQ ID NO: 2091 - DNA, 15 bp, Artificial Sequence
  Oligomeric compound
tggtaatccctggca

SEQ ID NO: 2092 - DNA, 15 bp, Artificial Sequence
  Oligomeric compound
gttgcgtggtaatcc

SEQ ID NO: 2093 - DNA, 15 bp, Artificial Sequence
  Oligomeric compound
gtggttgcgtggtaa

SEQ ID NO: 2094 - DNA, 15 bp, Artificial Sequence
  Oligomeric compound
gtcgtggttgcgtgg

SEQ ID NO: 2095 - DNA, 15 bp, Artificial Sequence
  Oligomeric compound
aaggtcgtggttgcg

SEQ ID NO: 2096 - DNA, 15 bp, Artificial Sequence
  Oligomeric compound
gacccagcgcgcgag

SEQ ID NO: 2097 - DNA, 15 bp, Artificial Sequence
  Oligomeric compound
cactggacccagcgc

SEQ ID NO: 2098 - DNA, 15 bp, Artificial Sequence
  Oligomeric compound
aaccactggacccag

SEQ ID NO: 2099 - DNA, 15 bp, Artificial Sequence
  Oligomeric compound
aagaaccactggacc

SEQ ID NO: 2100 - DNA, 15 bp, Artificial Sequence
  Oligomeric compound
gttaagaaccactgg

SEQ ID NO: 2101 - DNA, 15 bp, Artificial Sequence
  Oligomeric compound
ttgaactgttaagaa

SEQ ID NO: 2102 - DNA, 15 bp, Artificial Sequence
  Oligomeric compound
ctgttgaactgttaa

SEQ ID NO: 2103 - DNA, 15 bp, Artificial Sequence
  Oligomeric compound
gaactgttgaactgt

SEQ ID NO: 2104 - DNA, 15 bp, Artificial Sequence
  Oligomeric compound
acagaactgttgaac

SEQ ID NO: 2105 - DNA, 15 bp, Artificial Sequence
  Oligomeric compound
aattgcgctacagaa

SEQ ID NO: 2106 - DNA, 15 bp, Artificial Sequence
  Oligomeric compound
acaattgcgctacag

SEQ ID NO: 2107 - DNA, 15 bp, Artificial Sequence
  Oligomeric compound
tcacaattgcgctac

SEQ ID NO: 2108 - DNA, 15 bp, Artificial Sequence
  Oligomeric compound
tacagaactgttgaa

SEQ ID NO: 2109 - DNA, 15 bp, Artificial Sequence
  Oligomeric compound
gctacagaactgttg

SEQ ID NO: 2110 - DNA, 15 bp, Artificial Sequence
  Oligomeric compound
gcgctacagaactgt

SEQ ID NO: 2111 - DNA, 15 bp, Artificial Sequence
  Oligomeric compound
ttgcgctacagaact

SEQ ID NO: 2112 - DNA, 15 bp, Artificial Sequence
  Oligomeric compound
tttcacaattgcgct

SEQ ID NO: 2113 - DNA, 15 bp, Artificial Sequence
  Oligomeric compound
acatttcacaattgc

SEQ ID NO: 2114 - DNA, 15 bp, Artificial Sequence
  Oligomeric compound
taaacatttcacaat

SEQ ID NO: 2115 - DNA, 15 bp, Artificial Sequence
  Oligomeric compound
tcctaaacatttcac

SEQ ID NO: 2116 - DNA, 15 bp, Artificial Sequence
  Oligomeric compound
ctagtggtcctaaac

SEQ ID NO: 2117 - DNA, 15 bp, Artificial Sequence
  Oligomeric compound
ccgggtctagtggtc

SEQ ID NO: 2118 - DNA, 15 bp, Artificial Sequence
  Oligomeric compound
ccgccgggtctagtg

SEQ ID NO: 2119 - DNA, 15 bp, Artificial Sequence
  Oligomeric compound
cgcccgccgggtcta

SEQ ID NO: 2120 - DNA, 15 bp, Artificial Sequence
  Oligomeric compound
ccgcgcccgccgggt

SEQ ID NO: 2121 - DNA, 15 bp, Artificial Sequence
  Oligomeric compound
gctacccgacaaggt

SEQ ID NO: 2122 - DNA, 15 bp, Artificial Sequence
  Oligomeric compound
aagctacccgacaag

SEQ ID NO: 2123 - DNA, 15 bp, Artificial Sequence
  Oligomeric compound
gataagctacccgac

SEQ ID NO: 2124 - DNA, 15 bp, Artificial Sequence
  Oligomeric compound
tctgataagctaccc

SEQ ID NO: 2125 - DNA, 15 bp, Artificial Sequence
  Oligomeric compound
cagtctgataagcta

SEQ ID NO: 2126 - DNA, 15 bp, Artificial Sequence
  Oligomeric compound
tcaacatcagtctga

SEQ ID NO: 2127 - DNA, 15 bp, Artificial Sequence
  Oligomeric compound
cagtcaacatcagtc

SEQ ID NO: 2128 - DNA, 15 bp, Artificial Sequence
  Oligomeric compound
caacagtcaacatca

SEQ ID NO: 2129 - DNA, 15 bp, Artificial Sequence
  Oligomeric compound
attcaacagtcaaca

SEQ ID NO: 2130 - DNA, 15 bp, Artificial Sequence
  Oligomeric compound
gccatgagattcaac

SEQ ID NO: 2131 - DNA, 15 bp, Artificial Sequence
  Oligomeric compound
ttgccatgagattca

SEQ ID NO: 2132 - DNA, 15 bp, Artificial Sequence
  Oligomeric compound
tgttgccatgagatt

SEQ ID NO: 2133 - DNA, 15 bp, Artificial Sequence
  Oligomeric compound
ttcaacagtcaacat

SEQ ID NO: 2134 - DNA, 15 bp, Artificial Sequence
  Oligomeric compound
gattcaacagtcaac

SEQ ID NO: 2135 - DNA, 15 bp, Artificial Sequence
  Oligomeric compound
gagattcaacagtca

SEQ ID NO: 2136 - DNA, 15 bp, Artificial Sequence
  Oligomeric compound
atgagattcaacagt

SEQ ID NO: 2137 - DNA, 15 bp, Artificial Sequence
  Oligomeric compound
ccatgagattcaaca

SEQ ID NO: 2138 - DNA, 15 bp, Artificial Sequence
  Oligomeric compound
gtgttgccatgagat

SEQ ID NO: 2139 - DNA, 15 bp, Artificial Sequence
  Oligomeric compound
ctggtgttgccatga

SEQ ID NO: 2140 - DNA, 15 bp, Artificial Sequence
  Oligomeric compound
cgactggtgttgcca

SEQ ID NO: 2141 - DNA, 15 bp, Artificial Sequence
  Oligomeric compound
catcgactggtgttg

SEQ ID NO: 2142 - DNA, 15 bp, Artificial Sequence
  Oligomeric compound
gacagcccatcgact

SEQ ID NO: 2143 - DNA, 15 bp, Artificial Sequence
  Oligomeric compound
atgtcagacagccca

SEQ ID NO: 2144 - DNA, 15 bp, Artificial Sequence
  Oligomeric compound
aaatgtcagacagcc

SEQ ID NO: 2145 - DNA, 15 bp, Artificial Sequence
  Oligomeric compound
caaaatgtcagacag

SEQ ID NO: 2146 - DNA, 15 bp, Artificial Sequence
  Oligomeric compound
catgccccagacctg

SEQ ID NO: 2147 - DNA, 15 bp, Artificial Sequence
  Oligomeric compound
aggttcatgccccag

SEQ ID NO: 2148 - DNA, 15 bp, Artificial Sequence
  Oligomeric compound
gccaggttcatgccc

SEQ ID NO: 2149 - DNA, 15 bp, Artificial Sequence
  Oligomeric compound
tatgccaggttcatg

SEQ ID NO: 2150 - DNA, 15 bp, Artificial Sequence
  Oligomeric compound
ttgtatgccaggttc

SEQ ID NO: 2151 - DNA, 15 bp, Artificial Sequence
  Oligomeric compound
atctacattgtatgc

SEQ ID NO: 2152 - DNA, 15 bp, Artificial Sequence
  Oligomeric compound
gaaatctacattgta

SEQ ID NO: 2153 - DNA, 15 bp, Artificial Sequence
  Oligomeric compound
acagaaatctacatt

SEQ ID NO: 2154 - DNA, 15 bp, Artificial Sequence
  Oligomeric compound
aacacagaaatctac

SEQ ID NO: 2155 - DNA, 15 bp, Artificial Sequence
  Oligomeric compound
ctgttgcctaacgaa

SEQ ID NO: 2156 - DNA, 15 bp, Artificial Sequence
  Oligomeric compound
agctgttgcctaacg

SEQ ID NO: 2157 - DNA, 15 bp, Artificial Sequence
  Oligomeric compound
gtagctgttgcctaa

SEQ ID NO: 2158 - DNA, 15 bp, Artificial Sequence
  Oligomeric compound
gaacacagaaatcta

SEQ ID NO: 2159 - DNA, 15 bp, Artificial Sequence
  Oligomeric compound
acgaacacagaaatc

SEQ ID NO: 2160 - DNA, 15 bp, Artificial Sequence
  Oligomeric compound
taacgaacacagaaa

SEQ ID NO: 2161 - DNA, 15 bp, Artificial Sequence
  Oligomeric compound
cctaacgaacacaga

SEQ ID NO: 2162 - DNA, 15 bp, Artificial Sequence
  Oligomeric compound
tgcctaacgaacaca

SEQ ID NO: 2163 - DNA, 15 bp, Artificial Sequence
  Oligomeric compound
aatgtagctgttgcc

SEQ ID NO: 2164 - DNA, 15 bp, Artificial Sequence
  Oligomeric compound
gacaatgtagctgtt

SEQ ID NO: 2165 - DNA, 15 bp, Artificial Sequence
  Oligomeric compound
gcagacaatgtagct

SEQ ID NO: 2166 - DNA, 15 bp, Artificial Sequence
  Oligomeric compound
aaacccagcagacaa

SEQ ID NO: 2167 - DNA, 15 bp, Artificial Sequence
  Oligomeric compound
agcctgaaacccagc

SEQ ID NO: 2168 - DNA, 15 bp, Artificial Sequence
  Oligomeric compound
ggtagcctgaaaccc

SEQ ID NO: 2169 - DNA, 15 bp, Artificial Sequence
  Oligomeric compound
ccaggtagcctgaaa

SEQ ID NO: 2170 - DNA, 15 bp, Artificial Sequence
  Oligomeric compound
tttccaggtagcctg

SEQ ID NO: 2171 - DNA, 20 bp, Artificial Sequence
  Oligomeric compound
ccacattgagtttctttaag

SEQ ID NO: 2172 - DNA, 21 bp, Artificial Sequence
  PCR primer
catggaacacatggctgctaa

SEQ ID NO: 2173 - DNA, 24 bp, Artificial Sequence
  PCR primer
ggaaaggaaggtgtcagtgctact

SEQ ID NO: 2174 - DNA, 26 bp, Artificial Sequence
  PCR probe
tagcatggaccttaccgggcagaagg

SEQ ID NO: 2175 - DNA, 20 bp, Artificial Sequence
  PCR primer
gccagtacacctgccacaaa

SEQ ID NO: 2176 - DNA, 24 bp, Artificial Sequence
  PCR primer
gaccaaattccattttccttcttg

SEQ ID NO: 2177 - DNA, 28 bp, Artificial Sequence
  PCR probe
aggcgagactctgagccactcacatctg

SEQ ID NO: 2178 - DNA, 22 bp, Artificial Sequence
  PCR primer
cctagtgcgttatgcctaagca

SEQ ID NO: 2179 - DNA, 29 bp, Artificial Sequence
  PCR primer
ttcgtagagaacaacataagtcagatacc

SEQ ID NO: 2180 - DNA, 29 bp, Artificial Sequence
  PCR probe
tttctgaccacagtgaggaatgtccacaa

SEQ ID NO: 2181 - RNA, 19 nt, Artificial Sequence
  Oligomeric Compound
cgagaggcggacgggaccg

SEQ ID NO: 2182 - DNA, 21 bp, Artificial Sequence
  Oligomeric Compound
cgagaggcggacgggaccgtt

SEQ ID NO: 2183 - DNA, 21 bp, Artificial Sequence
  Oligomeric Compound
ttgctctccgcctgccctggc

SEQ ID NO: 2184 - DNA, 19 bp, Artificial Sequence
  Oligomeric Compound
gctctccgcctgccctggc

What is claimed is:

1. A method for inhibiting miR-122 in a cell, comprising contacting the cell with an oligomeric compound comprising an oligonucleotide consisting of 17 to 25 linked nucleosides, wherein the oligonucleotide is at least 90% complementary to nucleotides 29 to 51 of SEQ ID NO: 30, and wherein each nucleoside comprises a 2'-O-methoxyethyl sugar modification; and thereby inhibiting miR-122 in the cell.

2. The method of claim 1 wherein at least one internucleoside linkage of said oligomeric compound is a phosphorothioate internucleotide linkage.

3. The method of claim 2 wherein each internucleoside linkage is a phosphorothioate internucleoside linkage.

4. The method of claim 1 wherein the oligonucleotide is at least 95% complementary to nucleotides 29 to 51 of SEQ ID NO: 30.

5. The method of claim 1 wherein the oligonucleotide is 100% complementary to nucleotides 29 to 51 of SEQ ID NO: 30.

6. The method of claim 1, wherein at least one cytidine of said oligomeric compound is a 5-methylcytidine.

7. The method of claim 6, wherein each cytidine is a 5-methylcytidine.

8. The method of claim 1, wherein the oligomeric compound is an oligonucleotide.

9. The method of claim 1, wherein said oligomeric compound comprises at least one conjugate moiety.

10. The method of claim 9, wherein the conjugate moiety is cholesterol.

11. A method for inhibiting miR-122 in a cell comprising contacting the cell with an oligonucleotide consisting of 23 linked nucleosides and having the sequence of nucleobases set forth in SEQ ID NO: 313, wherein each nucleoside comprises a 2'-O-methoxyethyl sugar modification, wherein each internucleoside linkage is a phosphorothioate internucleoside linkage, and wherein each cytidine is a 5-methylcytidine; and thereby inhibiting miR-122 in the cell.

12. The method of claim 11, wherein said cell is contacted with a composition comprising the oligonucleotide and a pharmaceutically acceptable diluent.

13. The method of claim 1, wherein the oligonucleotide consists of 19 to 23 linked nucleosides.

14. The method of claim 1, wherein the oligonucleotide consists of 22 linked nucleosides.

15. The method of claim 1, wherein the oligonucleotide consists of 23 linked nucleosides.

16. A method for inhibiting miR-122 in a cell comprising contacting the cell with oligomeric compound comprising an oligonucleotide consisting of 15 to 30 linked nucleosides, wherein the oligonucleotide is at least 90% complementary to nucleotides 29 to 51 of SEQ ID NO: 30, and wherein each nucleoside comprises a sugar modification; and thereby inhibiting miR-122 in the cell.

17. The method of claim 16, wherein at least one sugar modification is a 2'-O-methoxyethyl sugar modification.

18. The method of claim 17, wherein each sugar modification is a 2'-O-methoxyethyl sugar modification.

19. The method of claim 16, wherein at least one sugar modification is a bicyclic sugar modification.

20. The method of claim 16, wherein at least one internucleoside linkage of said oligomeric compound is a phosphorothioate internucleoside linkage.

21. The method of claim 20, wherein each internucleoside linkage is a phosphorothioate internucleoside linkage.

22. The method of claim 16, wherein said oligomeric compound comprises at least one modified cytidine, wherein the modified cytidine is a 5-methylcytidine.

23. The method of claim 22 wherein each cytidine is a 5-methylcytidine.

24. The method of claim 16 wherein the oligonucleotide is at least 95% complementary to SEQ ID NO: 30.

25. The method of claim 16 wherein the oligonucleotide is 100% complementary to SEQ ID NO: 30.

26. The method of claim 16 wherein the oligonucleotide consists of 17 to 25 linked nucleosides.

27. The method of claim 16 wherein the oligonucleotide consists of 19 to 23 linked nucleosides.

28. The method of claim 16 wherein the oligonucleotide consists of 23 linked nucleosides.

29. The method oligomeric compound of claim 16 wherein the oligonucleotide consists of 22 linked nucleosides.

30. The method of claim 16 wherein the oligomeric compound consists of an oligonucleotide.

31. A method for inhibiting miR-122 in a cell comprising contacting the cell with an oligonucleotide consisting of 15 to 30 linked nucleosides, wherein each nucleoside comprises a sugar modification, wherein each internucleoside linkage is a phosphorothioate internucleoside linkage, and wherein the oligonucleotide is at least 90% complementary to nucleotides 29 to 51 of SEQ ID NO: 30 and thereby inhibiting miR-122 in the cell.

32. The method of claim 31, wherein said oligonucleotide consists of 17 to 25 linked nucleosides.

33. The method of claim 31, wherein said oligonucleotide consists of 19 to 23 linked nucleosides.

34. The method of claim 31, wherein said oligonucleotide consists of 22 linked nucleosides.

35. The method of claim 31, wherein said oligonucleotide consists of 23 linked nucleosides.

36. The method of claim 31 wherein at least one sugar modification of said oligonucleotide is a 2'-O-methoxyethyl sugar modification.

37. The method of claim 36, wherein each sugar modification is a 2'-O-methoxyethyl sugar modification.

38. The method of claim 31, wherein at least one sugar modification of said nucleotide is a bicyclic sugar modification.

39. The method of claim 31, wherein the oligonucleotide is at least 95% complementary to SEQ ID NO: 30.

40. The method of claim 31, wherein the oligonucleotide is 100% complementary to SEQ ID NO: 30.

* * * * *

UNITED STATES PATENT AND TRADEMARK OFFICE
CERTIFICATE OF CORRECTION

| | | |
|---|---|---|
| PATENT NO. | : 7,683,036 B2 | Page 1 of 1 |
| APPLICATION NO. | : 10/909125 | |
| DATED | : March 23, 2010 | |
| INVENTOR(S) | : C. Frank Bennett et al. | |

It is certified that error appears in the above-identified patent and that said Letters Patent is hereby corrected as shown below:

On the Title page, item (12) - should read: Bennett et al.

On the Title page, the listing of inventors in section (75) should be deleted and replaced with:

-- (75) Inventors: C. Frank Bennett, Carlsbad, CA (US); Susan M. Freier, San Diego, CA (US); Richard H. Griffey, Vista, CA (US) --

Signed and Sealed this
Eleventh Day of October, 2011

David J. Kappos
*Director of the United States Patent and Trademark Office*